United States Patent 7,745,391 (HUMAN THROMBOSPONDIN POLYPEPTIDE) - sequence listing, part 273

SEQ ID NO: 813958 - protein, 158 aa, Homo sapiens
MSHGKGTDMLPEIAAAVGFLSSLLRTRGCVSEQRLKVFSGALQEALTEHYKHHWFPEKPSKGSGYRCIRINHKMDPIISRVASQIGLSQPQLHQLLPSELTLWVDPYEVSYRIGEDGSICVLYEEAPLAASCGLLTCKNQVLLGRSSPSKNYVMAVSS

SEQ ID NO: 813959 - protein, 158 aa, Homo sapiens; identical to SEQ ID NO: 813958

SEQ ID NO: 813960 - protein, 158 aa, Homo sapiens; identical to SEQ ID NO: 813958

SEQ ID NO: 813961 - protein, 158 aa, Homo sapiens; identical to SEQ ID NO: 813958

SEQ ID NO: 813962 - protein, 158 aa, Homo sapiens; identical to SEQ ID NO: 813958

SEQ ID NO: 813963 - protein, 158 aa, Homo sapiens; identical to SEQ ID NO: 813958

SEQ ID NO: 813964 - protein, 164 aa, Homo sapiens
GGVHRGKIEQFRNPGKGTVVGWRKVESYTGKKLPSFNFSVTLMRGPQKTSSFPNRITLRRTGLGHLARMATLLLLPLSEESSPHFLYPQVLLPTASPLSWISKLLNFDSKVLFTKHSPYPFLPALPPFQLSTFCIAFPDLLPVFIALKFTLGPQTQELIFWFVG

SEQ ID NO: 813965 - protein, 135 aa, Homo sapiens
ITPKLATHTHAALAKQRCAEFPSILTPITSSSLLLWVARMATLLLLPLSEESSPHFLYPQVLLPTASPLSWISKLLNFDSKVLFTKHSPYPFLPALPPFQLSTFCIAFPDLLPVFIALKFTLGPQTQELIFWFVG

SEQ ID NO: 813966 - protein, 91 aa, Homo sapiens
DSRSPDVARQSRLARQSTSPTASPLSWISKLLNFDSKVLFTKHSPYPFLPALPPFQLSTFCIAFPDLLPVFIALKFTLGPQTQELIFWFVG

SEQ ID NO: 813967 - protein, 158 aa, Homo sapiens; identical to SEQ ID NO: 813958

SEQ ID NO: 813968 - protein, 158 aa, Homo sapiens; identical to SEQ ID NO: 813958

SEQ ID NO: 813969 - protein, 396 aa, Homo sapiens
MWIPVVGLPRRLRLSALAGAGRFCILGSEAATRKHLPARNHCGLSDSSPQLWPEPDFRNPPRKASKASLDFKRYVTDRRLAETLAQIYLGKPSRPPHLLLECNPGPGILTQALLEAGAKVVALESDKTFIPHLESLGKNLDGKLRVIHCDFFKLDPRSGGVIKPPAMSSRGLFKNLGIEAVPWTADIPLKVVGMFPSRGEKRALWKLAYDLYSCTSIYKFGRIEVNMFIGEKEFQKLMADPGNPDLYHVLSVIWQLACEIKVLHMEPWSSFDIYTRKGPLENPKRRELLDQLQQKLYLIQMIPRQNLFTKNLTPMNYNIFFHLLKHCFGRRSATVIDHLRSLTPLDARDILMQIGKQEDEKVVNMHPQDFKTLFETIERSKDCAYKWLYDETLEDR

SEQ ID NO: 813970 - protein, 396 aa, Homo sapiens; identical to SEQ ID NO: 813969

SEQ ID NO: 813971 - protein, 422 aa, Homo sapiens
MWIPVVGLPRRLRLSALAGAGRFCILGSEAATRKHLPARNHCGLSDSSPQLWPEPDFRNPPRKASKASLDFKRYVTDRRLAETLAQIYLGKPSRPPHLLLECNPGPGILTQALLEAGAKVVALESDKTFIPHLEGLTPIAQAGVQCCSHSSLQSQLPRLQSLGKNLDGKLRVIHCDFFKLDPRSGGVIKPPAMSSRGLFKNLGIEAVPWTADIPLKVVGMFPSRGEKRALWKLAYDLYSCTSIYKFGRIEVNMFIGEKEFQKLMADPGNPDLYHVLSVIWQLACEIKVLHMEPWSSFDIYTRKGPLENPKRRELLDQLQQKLYLIQMIPRQNLFTKNLTPMNYNIFFHLLKHCFGRRSATVIDHLRSLTPLDARDILMQIGKQEDEKVVNMHPQDFKTLFETIERSKDCAYKWLYDETLEDR

SEQ ID NO: 813972 - protein, 203 aa, Homo sapiens
MFPSRGEKRALWKLAYDLYSCTSIYKFGRIEVNMFIGEKEFQKLMADPGNPDLYHVLSVIWQLACEIKVLHMEPWSSFDIYTRKGPLENPKRRELLDQLQQKLYLIQMIPRQNLFTKNLTPMNYNIFFHLLKHCFGRRSATVIDHLRSLTPLDARDILMQIGKQEDEKVVNMHPQDFKTLFETIERSKDCAYKWLYDETLEDR

SEQ ID NO: 813973 - protein, 295 aa, Homo sapiens
MWIPVVGLPRRLRLSALAGAGRFCILGSEAATRKHLPARNHCGLSDSSPQLWPEPDFRNPPRKASKASLDFKRYVTDRRLAETLAQIYLGKPSRPPHLLLECNPGPGILTQALLEAGAKVVALESDKTFIPHLEKLMADPGNPDLYHVLSVIWQLACEIKVLHMEPWSSFDIYTRKGPLENPKRRELLDQLQQKLYLIQMIPRQNLFTKNLTPMNYNIFFHLLKHCFGRRSATVIDHLRSLTPLDARDILMQIGKQEDEKVVNMHPQDFKTLFETIERSKDCAYKWLYDETLEDR

SEQ ID NO: 813974 - protein, 396 aa, Homo sapiens; identical to SEQ ID NO: 813969

SEQ ID NO: 813975 - protein, 238 aa, Homo sapiens
MWIPVVGLPRRLRLSALAGAGRFCILGSEAATRKHLPARNHCGLSDSSPQLWPEPDFRNPPRKASKASLDFKRYVTDRRLAETLAQIYLGKPSRPPHLLLECNPGPGILTQALLEAGAKVVALESDKTFIPHLESLGKNLDGKLRVIHCDFFKLDPRSGGVIKPPAMSSRGLFKNLGIEAVPWTADIPLKVVGMFPSRGEKRALWKLAYDLYSCTSIYKFGRIEVNMFIGEKEFQVCY

SEQ ID NO: 813976 - protein, 186 aa, Homo sapiens
MVRPKKVCFSESSLPTGDRTRRSYYLNEIQSFAGAEKDARVVGEIAFQLDRRILAYVFPGVTRLYGFTVANIPEKIEQTSTKSLDGSVDERKLRELTQRYLALSARLEKLGYSRDVHPAFSEFLINTYGILKQRPDLRANPLHSSPAALRKLVIDVVPPKFLGDSLLLLNCLCELSKEDGKPLFAW

SEQ ID NO: 813977 - protein, 444 aa, Homo sapiens
MREIVHIQAGQCGNQIGAKFWEVISDEHGIDPTGTYHGDSDLQLDRISVYYNEATGGKYVPRAILVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 813978 - protein, 127 aa, Homo sapiens
MSPSEGPEPPTPIHALRPQTSTKSLDGSVDERKLRELTQRYLALSARLEKLGYSRDVHPAFSEFLINTYGILKQRPDLRANPLHSSPAALRKLVIDVVPPKFLGDSLLLLNCLCELSKEDGKPLFAW

SEQ ID NO: 813979 - protein, 111 aa, Homo sapiens
MGWGRPQLRAGRSSAVRNNWCLRHGRSWSEGWTCTAGPFSSGSEVSRWPPAQPSGPPSAPKHVGAIVGLPQAGLPTLGWSPPQDWSPPPGWSPPQGWSPPPGWSPHQAGLL

SEQ ID NO: 813980 - protein, 212 aa, Homo sapiens [sequence omitted]

SEQ ID NO: 813981 - protein, 185 aa, Homo sapiens
MVLFKRDRREDTQQGHHSMNGRCTDHFLFVLSSLLSPAAILVRLVPARERCPQVKGYSGTWEKAPGRFPCGPAQHGSRVGTLLCRQRSLYSSGFLKALPCLCQACAASHPTAAWERPATLPVHTSLSTHSLSTHSLSTTAAGPSAYGHPIQAAAPPLFGMVICVFSLGAYVCGLGTSAGMHLGPS

SEQ ID NO: 813982 - protein, 136 aa, Homo sapiens
MSLSPGSPWFVRVPRDQSPWTLLGDLEALKKETIVLKEGSEYRVKIHFKVNRDIVSGLKYVQHTYRTGVKVDKATFMVGSYGPRPEEYEFLTPVEEAPKGMLARGTYHNKSFFTDDDKQDHLSWEWNLSIKKEWTE

SEQ ID NO: 813983 - protein, 136 aa, Homo sapiens; identical to SEQ ID NO: 813982

SEQ ID NO: 813984 - protein, 108 aa, Homo sapiens
MTEKAPEPHVEEDDDDELDSKLNYKPPPQKSLKELQEMDKDDESLIKYKKTLLGDGPVVTDPKAPNVVVTRLTLVCESAPGPITMDLTGDLEALIKGNRDIASALKYV

SEQ ID NO: 813985 - protein, 105 aa, Homo sapiens
MTEKAPEPHVEEDDDDELDSKLNYKPPPQKSLKELQEMDKDDESLIKYKKTLLGDGPVVTDPKAPNVVVTRLTLVCESAPGPITMDLTGRSGSPQKGNHCVKGRF

SEQ ID NO: 813986 - protein, 136 aa, Homo sapiens; identical to SEQ ID NO: 813982

SEQ ID NO: 813987 - protein, 136 aa, Homo sapiens; identical to SEQ ID NO: 813982

SEQ ID NO: 813988 - protein, 136 aa, Homo sapiens; identical to SEQ ID NO: 813982

SEQ ID NO: 813989 - protein, 136 aa, Homo sapiens; identical to SEQ ID NO: 813982

SEQ ID NO: 813990 - protein, 136 aa, Homo sapiens; identical to SEQ ID NO: 813982

SEQ ID NO: 813991 - protein, 136 aa, Homo sapiens; identical to SEQ ID NO: 813982

SEQ ID NO: 813992 - protein, 136 aa, Homo sapiens; identical to SEQ ID NO: 813982

SEQ ID NO: 813993 - protein, 136 aa, Homo sapiens; identical to SEQ ID NO: 813982

SEQ ID NO: 813994 - protein, 105 aa, Homo sapiens; identical to SEQ ID NO: 813985

SEQ ID NO: 813995 - protein, 105 aa, Homo sapiens; identical to SEQ ID NO: 813985

SEQ ID NO: 813996 - protein, 136 aa, Homo sapiens; identical to SEQ ID NO: 813982

SEQ ID NO: 813997 - protein, 105 aa, Homo sapiens; identical to SEQ ID NO: 813985

SEQ ID NO: 813998 - protein, 136 aa, Homo sapiens; identical to SEQ ID NO: 813982

SEQ ID NO: 813999 - protein, 136 aa, Homo sapiens; identical to SEQ ID NO: 813982

SEQ ID NO: 814000 - protein, 136 aa, Homo sapiens; identical to SEQ ID NO: 813982

SEQ ID NO: 814001 - protein, 136 aa, Homo sapiens; identical to SEQ ID NO: 813982

SEQ ID NO: 814002 - protein, 105 aa, Homo sapiens; identical to SEQ ID NO: 813985

SEQ ID NO: 814003 - protein, 136 aa, Homo sapiens; identical to SEQ ID NO: 813982

SEQ ID NO: 814004 - protein, 136 aa, Homo sapiens; identical to SEQ ID NO: 813982

SEQ ID NO: 814005 - protein, 105 aa, Homo sapiens; identical to SEQ ID NO: 813985

SEQ ID NO: 814006 - protein, 126 aa, Homo sapiens
MDLGLRSMSSSLQLRRLPRACWREARTTTSPSSPTMTSKTTSAGSGTCRLRRSGQNECIHPFPHPCHLERILSGVFSTLSLLPVHSWVPLQHCPHFLIDASFPTLSLNVVPRTRGLKPGFHPTCSL

SEQ ID NO: 814007 - protein, 105 aa, Homo sapiens; identical to SEQ ID NO: 813985

SEQ ID NO: 814008 - protein, 89 aa, Homo sapiens
IEGNNLIEEKHTLQTGESGLQPTVDKATFMVGSYGPRPEEYEFLTPVEEAPKGMLARGTYHNKSFFTDDDKQDHLSWEWNLSIKKEWTE

SEQ ID NO: 814009 - protein, 105 aa, Homo sapiens; identical to SEQ ID NO: 813985

SEQ ID NO: 814010 - protein, 105 aa, Homo sapiens; identical to SEQ ID NO: 813985

SEQ ID NO: 814011 - protein, 66 aa, Homo sapiens
ESKQCQSPNSARVQTVPESKQCQQSKQCQSPNSPHFLIDASFPTLSLNVVPRTRGLKPGFHPTCSL

SEQ ID NO: 814012 - protein, 112 aa, Homo sapiens
MTEKAPEPHVEEDDDDELDSKLNYKPPPQKSLKELQEMDKDDESLIKYKKTLLGDGPVVTDPKAPNVVVTRLTLVCESAPGPITMDLTGDLGPQAMVDPFVAFALGHPDDVD

SEQ ID NO: 814013 - protein, 105 aa, Homo sapiens; identical to SEQ ID NO: 813985

SEQ ID NO: 814014 - protein, 770 aa, Homo sapiens
ALWMCIVLNPHCKLEQKASWLKQLKKWNSVDVCPWEDGNHGSELPNLTNALPQGANANQDSSNRPHRTVFTRAIEACDLHWQDSHLQHIISSDLYTNYCYHDDTENSLFDSRGWPLWHEHVPTACARVDALRSHGYPREALRLAIAIVNTLRRQQQKQLEMFRTQKKELPHKNITSITNLEGWVGHPLDPVGTLFSSLMEACRIDDENLSGFSDFTENMGQCKSLEYQHLPAHKFLEEGESYLTLAVEVALIGLGQQRIMPDGLYTQEKVCRNEEQLISKLQEIELDDTLVKIFRKQAVFLLEAGPYSGLGEIIHRESVPMHTFAKYLFTSLLPHDAELAYKIALRAMRLLVLESTAPSGDLTRPHHIASVVPNRYPRWFTLSHIESQQCELASTMLTAAKGDVRRLETVLESIQKNIHSSSHIFKLAQDAFKIATLMDSLPDITLLKVSLELGLQVMRMTLSTLNWRRREMVRWLVTCATEVGVYALDSIMQTWFTLFTPTEATSIVATTVMSNSTIVRLHLDCHQQEKLASSARTLALQCAMKDPQNCALSALTLCEKDHIAFETAYQIVLDAATTGMSYTQLFTIARYMEHRGYPMRAYKLATLAMTHLNLSYNQDTHPAINDVLWACALSHSLGKNELAAIIPLVVKSVKCATVLSDILRRCTLTTPGMVGLHGRRNSGKLMSLDKAPLRQLLDATIGAYINTTHSRLTHISPRHYSEFIEFLSKARETFLMAHDGHIQFTQFIDNLKQIYKGKKKLMMLVRERFG

SEQ ID NO: 814015 - protein, 770 aa, Homo sapiens; identical to SEQ ID NO: 814014

SEQ ID NO: 814016 - protein, 770 aa, Homo sapiens; identical to SEQ ID NO: 814014

SEQ ID NO: 814017 - protein, 770 aa, Homo sapiens
RAAAASPLRMSRKGPRAEVCADCSAPDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDLSKQLHSSVRTGNLETCLRLLSLGAQANFFHPEKGTTPLHVAAKAGQTLQAELLVVYGADPGSPDVNGRTPIDYARQAGHHELAERLVECQYELTDRLAFYLCGRKPDHKNGHYIIPQMADSLDLSELAKAAKKKLQALSNRLFEELAMDVYDEVDRRENDAVWLATQNHSTLVTERSAVPFLPVNPEYSATRNQGRQKLARFNAREFATLIIDILSEAKRRQQGKSLSSPTDNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 814018 - protein, 206 aa, Homo sapiens
SGEEGVKGTAEADTTFPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 814019 - protein, 63 aa, Homo sapiens
MSTKNTVNQDNRWRKKAQHWAQMNGYQYAVGSETTGAATRGKRMEEQLAKRLRKRRNEDNNED

SEQ ID NO: 814020 - protein, 511 aa, Homo sapiens [sequence omitted]

SEQ ID NO: 814021 - protein, 779 aa, Homo sapiens
RAAAASPLRMSRKGPRAEVCADCSAPDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDLSKQLHSSVRTGNLETCLRLLSLGAQANFFHPEKGTTPLHVAAKAGQTLQAELLVVYGADPGSPDVNGRTPIDYARQAGHHELAERLVECQYELTDRLAFYLCGRKPDHKNGHYIIPQMADRSRQKCMSQSLDLSELAKAAKKKLQALSNRLFEELAMDVYDEVDRRENDAVWLATQNHSTLVTERSAVPFLPVNPEYSATRNQGRQKLARFNAREFATLIIDILSEAKRRQQGKSLSSPTDNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 814022 - protein, 754 aa, Homo sapiens
RAAAASPLRMSRKGPRAEVCADCSAPDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDLSKQLHSSVRTGNLETCLRLLSLGAQANFFHPEKGTTPLHVAAKAGQTLQAELLVVYGADPGSPDVNGRTPIDYARQAGHHELAERLVECQYELTDRLAFYLCGRKPDHKNGHYIIPQMADSLDLSELAKAAKKKLQALSNRLFEELAMDVYDEVDRRENDAVWLATQNHSTLVTERSAVPFLPVNPEYSATRNQGRQKLARFNAREFATLIIDILNNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 814023 - protein, 592 aa, Homo sapiens
MASTLVETKSEKRRKQKSTKRCCQCLSGVGPWLLPGVMKGRACSMQYGSRETFSHIFLTPAHPHPNLGVMEIFQQGSPPLLRYPGGEFGTRAKAAKKKLQALSNRLFEELAMDVYDEVDRRENDAVWLATQNHSTLVTERSAVPFLPVNPEYSATRNQGRQKLARFNAREFATLIIDILSEAKRRQQGKSLSSPTDNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 814024 - protein, 488 aa, Homo sapiens
MASTLVETKSEKRRKQKSTKRCCQCLSGVGPWLLPGVMKGRACSMQYGSRETFSHIFLTPAHPHPNLGVMEIFQQGSPPLLRYPGGEFGTRDNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 814025 - protein, 797 aa, Homo sapiens
RAAAASPLRMSRKGPRAEVCADCSAPDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDLSKQLHSSVRTGNLETCLRLLSLGAQANFFHPEKGTTPLHVAAKAGQTLQAELLVVYGADPGSPDVNGRTPIDYARQAGHHELAERLVECQYELTDRLAFYLCGRKPDHKNGHYIIPQMADSLDLSELAKAAKKKLQALSNRLFEELAMDVYDEVDRRENDAVWLATQNHSTLVTERSAVPFLPVNPEYSATRNQGRQKLARFNAREFATLIIDILSEAKRRQQGKSLSSPTDNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDRDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 814026 - protein, 852 aa, Homo sapiens
RAAAASPLRMSRKGPRAEVCADCSAPDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDLSKQLHSSVRTGNLETCLRLLSLGAQANFFHPEKGTTPLHVAAKAGQTLQAELLVVYGADPGSPDVNGRTPIDYARQAGHHELAERLVECQYELTDRLAFYLCGRKPDHKNGHYIIPQMADSLDLSELAKAAKKKLQALSNRLFEELAMDVYDEVDRRENDAVWLATQNHSTLVTERSAVPFLPVNPEYSATRNQGRQKLARFNAREFATLIIDILSEAKRRQQGKSLSSPTDNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDRDVILKTEQVTKNIQELLRAAQEFKHDSFVPCSEKIHLAVTEMASLFPKVQGPKRGPGVGGPRAGAGVENPICIATWVETQTNWALISAGGLKSKVQPHSCPLQRPALEPVRSSLRLLNASAYRLQSECRKTVPPEPGAPVDFQLLTQQVIQCAYDIAKAAKQLVTITTREKKQ

SEQ ID NO: 814027 - protein, 206 aa, Homo sapiens; identical to SEQ ID NO: 814018

SEQ ID NO: 814028 - protein, 137 aa, Homo sapiens
LDPGLCSVFKMTSSVLEAQDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 814029 - protein, 770 aa, Homo sapiens; identical to SEQ ID NO: 814017

SEQ ID NO: 814030 - protein, 770 aa, Homo sapiens; identical to SEQ ID NO: 814017

SEQ ID NO: 814031 - protein, 770 aa, Homo sapiens; identical to SEQ ID NO: 814017

SEQ ID NO: 814032 - protein, 770 aa, Homo sapiens; identical to SEQ ID NO: 814017

SEQ ID NO: 814033 - protein, 770 aa, Homo sapiens; identical to SEQ ID NO: 814017

SEQ ID NO: 814034 - protein, 770 aa, Homo sapiens; identical to SEQ ID NO: 814017

SEQ ID NO: 814035 - protein, 770 aa, Homo sapiens; identical to SEQ ID NO: 814017

SEQ ID NO: 814036 - protein, 184 aa, Homo sapiens
EVWARLRFNPRWRRRRRPWQGRMETLKDKTLQELEELQNDSEAIDQLALESPEVQDLQLEREMALATNRSLAERNLEFQGPLEISRSNLSDRYQELRKLVERCQEQKAKLEKFSSALQPGTLLDLLQVEGMKIEEESEVRGRGDTPLPWTGCQSLQQGPLEGEADVCKAWNKGAFVDGRGEGHL

SEQ ID NO: 814037 - protein, 377 aa, Homo sapiens
EVWARLRFNPRWRRRRRPWQGRMETLKDKTLQELEELQNDSEAIDQLALESPEVQDLQLEREMALATNRSLAERNLEFQGPLEISRSNLSDRYQELRKLVERCQEQKAKLEKFSSALQPGTLLDLLQVEGMKIEEESEAMAEKFLEGEVPLETFLENFSSMRMLSHLRRVRVEKLQEVVRKPRASQELAGDAPPARPPAPVRPVPQGTPPVVEEQPQPPSAMPPYPLPYSPSPSLPVGPTAHGALPPAPFPVVSQPSFYSGPLGPTYPAAQLGPRGAAGYSWSPQRSMPPRPGYPGTPMGASGPGYPLRGGRAPSPGYPQQSPYPATGGKPPYPIQPQLPSFPGQPQPSVPLQPPYPPGPAPPYGFPPPPGPAWPGY

SEQ ID NO: 814038 - protein, 377 aa, Homo sapiens; identical to SEQ ID NO: 814037

SEQ ID NO: 814039 - protein, 95 aa, Homo sapiens
GRERVCVARCRGNSEAREAGRPTGSRGEHARHWGAGRCKGVTSGRGRAWRTPEVWARLRFNPRWRRRRRPWQVSGDWGGSRLCRRRAGQRTTVGA

SEQ ID NO: 814040 - protein, 452 aa, Homo sapiens
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMSLLEDKGLAEVSKVAEQVLNAVNKGLYREATELWGKAEMIIEQNTDGVNFYNILTKSTPTSTMESSLEFTQSHLVCLCQRHVRHLQRDALSQLMNGPIRKKLKIIPEDQSWGGQATNVFVNMEEDFMKPVISIVDELLEAGINVTVYNGQLDLIVDTMGQEAWVRKLKWPELPKFSQLKWKALYSDPKSLETSAFVKSYKNLAFYWILKAGHMVPSDQGDMALKMMRLVTQQE

SEQ ID NO: 814041 - protein, 452 aa, Homo sapiens; identical to SEQ ID NO: 814040

SEQ ID NO: 814042 - protein, 434 aa, Homo sapiens
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMSLLEDKGLAEVSKVAEQVLNAVNKGLYREATELWGKAEMIIEQNTDGVNFYNILTKSTPTSTMESSLEFTQSHLVCLCQRHVRHLQRDALSQLMNGPIRKKLKMEEDFMKPVISIVDELLEAGINVTVYNGQLDLIVDTMGQEAWVRKLKWPELPKFSQLKWKALYSDPKSLETSAFVKSYKNLAFYWILKAGHMVPSDQGDMALKMMRLVTQQE

SEQ ID NO: 814043 - protein, 414 aa, Homo sapiens
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMSLLEDKGLAEVSKVAEQVLNAVNKGLYREATELWGKAEMIIEQNTDGVNFYNILTKSTPTSTMESSLEFTQSHLGQATNVFVNMEEDFMKPVISIVDELLEAGINVTVYNGQLDLIVDTMGQEAWVRKLKWPELPKFSQLKWKALYSDPKSLETSAFVKSYKNLAFYWILKAGHMVPSDQGDMALKMMRLVTQQE

SEQ ID NO: 814044 - protein, 316 aa, Homo sapiens [sequence omitted]

SEQ ID NO: 814045 - protein, 360 aa, Homo sapiens
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMSLLEDKGLAEVSKVAEQVLNAVNKGLYREATELWGKAEMIIEQNTDGVNFYNILTKSTPTSTMESSLEFTQSHLVCLCQRHVRHLQRDALSQLMNGPIRKKLKIIPEDQSWGGQATNVFVNMEEDFMKPVISIVDEAGWGD

SEQ ID NO: 814046 - protein, 472 aa, Homo sapiens
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMQYQIDVPKLSGSFCSWFAFQSLLEDKGLAEVSKVAEQVLNAVNKGLYREATELWGKAEMIIEQNTDGVNFYNILTKSTPTSTMESSLEFTQSHLVCLCQRHVRHLQRDALSQLMNGPIRKKLKIIPEDQSWGGQATNVFVNMEEDFMKPVISIVDELLEAGINVTVYNGQLDLIVDTMGQEAWVRKLKWPELPKFSQLKWKALYSDPKSLETSAFVKSYKNLAFYWILKAGHMVPSDQGDMALKMMRLVTQQE

SEQ ID NO: 814047 - protein, 295 aa, Homo sapiens
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMSLLEDKGLAEVSKVAEQVLNAVNKGLYREATELWGKAEMIIEQNTDGVNFYNILTKSTPTSTMESSLEFTQSHLGE

SEQ ID NO: 814048 - protein, 323 aa, Homo sapiens
MELALRRSPVPRWLLLLPLLLGLNAGAVIDWPTEEGKEVWDYVTVRKDAYMFWWLYYATNSCKNFSELPLVMWLQGGPGGSSTGFGNFEEIGPLDSDLKPRKTTWLQAASLLFVDNPVGTGFSYVNGSGAYAKDLAMVASDMMVLLKTFFSCHKEFQTVPFYIFSESYGGKMAAGIGLELYKAIQRGTIKCNFAGVALGDSWISPVDSVLSWGPYLYSMSLLEDKGLAEVSKVAEQVLNAVNKGLYREATELWGKAEMIIEQNTDGVNFYNILTKSTPTSTMESSLEFTQSHLAESETLPLAVQHPQQLGKDVLMARRGGSHL

SEQ ID NO: 814049 - protein, 176 aa, Homo sapiens
SSWPYFQPFDSLSTSLVFCLCQRHVRHLQRDALSQLMNGPIRKKLKIIPEDQSWGGQATNVFVNMEEDFMKPVISIVDELLEAGINVTVYNGQLDLIVDTMGQEAWVRKLKWPELPKFSQLKWKALYSDPKSLETSAFVKSYKNLAFYWILKAGHMVPSDQGDMALKMMRLVTQQE

SEQ ID NO: 814050 - protein, 129 aa, Homo sapiens
KINVNGVYGQLDLIEITWEEDFMKPVISIVDELLEAGINVTVYNGQLDLIVDTMGQEAWVRKLKWPELPKFSQLKWKALYSDPKSLETSAFVKSYKNLAFYWILKAGHMVPSDQGDMALKMMRLVTQQE

SEQ ID NO: 814051 - protein, 293 aa, Homo sapiens [sequence omitted]

SEQ ID NO: 814052 - protein, 328 aa, Homo sapiens
PTRPAAHCGICRLVRWWRKRRSVMGIQTSPVLLASLGVGLVTLLGLAVGSYLVRRSRRPQVTLLDPNEKYLLRLLDKTTVSHNTKRFRFALPTAHHTLGLPVGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKDWAYSKGFVTADMIREHLPAPGDDVLVLLCGPPPMVQLACHPNLDKLGYSQKMRFTY

SEQ ID NO: 814053 - protein, 332 aa, Homo sapiens
PTRPAAHCGICRLVRWWRKRRSVMGIQTSPVLLASLGVGLVTLLGLAVGSYLVRRSRRPQVTLLDPNEKYLLRLLDKTTVSHNTKRFRFALPTAHHTLGLPVGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKDWAYSKGFVTADMIREHLPAPGDDVLVLLCGPPPMVQLACHPNLDKLGYSLQLFPISTQAL

SEQ ID NO: 814054 - protein, 328 aa, Homo sapiens; identical to SEQ ID NO: 814052

SEQ ID NO: 814055 - protein, 175 aa, Homo sapiens
MSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKDWAYSKGFVTADMIREHLPAPGDDVLVLLCGPPPMVQLACHPNLDKLGYSQKMRFTY

SEQ ID NO: 814056 - protein, 317 aa, Homo sapiens
SSTHASGKRRSVMGIQTSPVLLASLGVGLVTLLGLAVGSYLVRRSRRPQVTLLDPNEKYLLRLLDKTTVSHNTKRFRFALPTAHHTLGLPVGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKDWAYSKGFVTADMIREHLPAPGDDVLVLLCGPPPMVQLACHPNLDKLGYSQKMRFTY

SEQ ID NO: 814057 - protein, 175 aa, Homo sapiens; identical to SEQ ID NO: 814055

SEQ ID NO: 814058 - protein, 367 aa, Homo sapiens
PTRPAAHCGICRLVRWWRKRRSVMGIQTSPVLLASLGVGLVTLLGLAVGSYLVRRSRRPQVTLLDPNEKYLLRLLDKTTVSHNTKRFRFALPTAHHTLGLPVAPWDHSRKQDILFSQISLSILRDAAHHRQPLCELSARSPGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKDWAYSKGFVTADMIREHLPAPGDDVLVLLCGPPPMVQLACHPNLDKLGYSQKMRFTY

SEQ ID NO: 814059 - protein, 364 aa, Homo sapiens
TRLVRPRGYGLRWWRHRRSVMGIQTSPVLLASLGVGLVTLLGLAVGSYLVRRSRRPQVTLLDPNEKYLLRLLDKTTVSHNTKRFRFALPTAHHTLGLPVAPWDHSRKQDILFSQISLSILRDAAHHRQPLCELSARSPGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKDWAYSKGFVTADMIREHLPAPGDDVLVLLCGPPPMVQLACHPNLDKLGYSQKMRFTY

SEQ ID NO: 814060 - protein, 317 aa, Homo sapiens
PTRPAAHCGICRLVRWWRKRRSVMGIQTSPVLLASLGVGLVTLLGLAVGSYLVRRSRRPQVTLLDPNEKYLLRLLDKTTVSHNTKRFRFALPTAHHTLGLPVGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKGILPISGHPTIPSSSKSKPCPFVNSGFIEINLASHCQLGSLSAQTQ

SEQ ID NO: 814061 - protein, 83 aa, Homo sapiens
PTRPAAHCGICRLVRWWRKRRSVMGIQTSPVLLASLGVGLVTLLGLAVGSYLVRRSRRPQVTLLDPNEKYCSCSPSVLKHYKP

SEQ ID NO: 814062 - protein, 216 aa, Homo sapiens
SDPPRGALWDLSACQVVEEKALRHGDPDGKTLIQYPPLGDPSPSGSGHSAPDQGLSLPTPPRRALGPPWMLGSRSRYIRARDSARLPLCPWHASALELGIATPGTVTTQAPGSYPAWRSRCLLYPQSPVLLASLGVGLVTLLGLAVGSYLVRRSRRPQVTLLDPNEKYLLRLLDKTVSWGRKGQGEGGDQSAPGMEGTAPTVVGMSKGRGSARRAW

SEQ ID NO: 814063 - protein, 213 aa, Homo sapiens
PTRPAAHCGICRLVRWWRKRRSVMGIQTSPVLLASLGVGLVTLLGLAVGSYLVRRSRRPQVTLLDPNEKYLLRLLDKTTVSHNTKRFRFALPTAHHTLGLPVGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGALH

SEQ ID NO: 814064 - protein, 335 aa, Homo sapiens
LDCRGGFWAKMAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVAAGAKEVVIFGAASELFTKKNINCSIEESFQRFDAILKAAQSANISVRGYVSCALGCPYEGKISPAKVAEVTKKFYSMGCYEISLGDTIGVGTPGIMKDMLSAVMQEVPLAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 814065 - protein, 216 aa, Homo sapiens
LDCRGGFWAKMAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVAAGAKEVVIFGAASELFTKKNINCSIEESFQRFDAILKAAQSANISVRGYVSCALGCPYEGKISPAKVAEVCACVRAGGLVRVGHLVCP

SEQ ID NO: 814066 - protein, 112 aa, Homo sapiens
MGIEFDQPKNLCHLVLKTTVQIWYYYSLLQLRKLTLNNLPHRLQMVKSGIKPHFFSLQSPLLPRILCGIQIGGMVTVQLFLESSCPAPGLSLSCHNPCHMTKGSSPFFRSRN

SEQ ID NO: 814067 - protein, 136 aa, Homo sapiens
LDCRGGFWAKMAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVRLLCSWLPL

SEQ ID NO: 814068 - protein, 264 aa, Homo sapiens
LDCRGGFWAKMAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVTKKFYSMGCYEISLGDTIGVGTPGIMKDMLSAVMQEVPLAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 814069 - protein, 335 aa, Homo sapiens; identical to SEQ ID NO: 814064

SEQ ID NO: 814070 - protein, 307 aa, Homo sapiens
LDCRGGFWAKMAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVAAGAKEVVIFGAASELFTKKNINCSIEESFQRFDAILKAAQSANISVRGYVSCALGCPYEGKISPAKVAEVTKKFYSMGCYEISLGDTIGVGTPGIMKDMLSAVMQEVPLAALAVHCHDTYGQALANTLMALQLTVIPCPGSWAFLQLMRFPARQTGRVTSSPMPCQAGKGEFCTAEGTG

SEQ ID NO: 814071 - protein, 129 aa, Homo sapiens
LDCRGGFWAKMAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVRG

SEQ ID NO: 814072 - protein, 123 aa, Homo sapiens
LDCRGGFWAKMAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLALPLTAL

SEQ ID NO: 814073 - protein, 82 aa, Homo sapiens
GGFWAKMAAMRKALPRRLVGLASLRAVSAPSRRGGGPAGTLTVRVGGLARGDCSLRGEAGQLSGQSREGVGVLDPPFSPQIL

SEQ ID NO: 814074 - protein, 640 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 814075 - protein, 640 aa, Homo sapiens; identical to SEQ ID NO: 814074

SEQ ID NO: 814076 - protein, 640 aa, Homo sapiens; identical to SEQ ID NO: 814074

SEQ ID NO: 814077 - protein, 640 aa, Homo sapiens; identical to SEQ ID NO: 814074

SEQ ID NO: 814078 - protein, 640 aa, Homo sapiens; identical to SEQ ID NO: 814074

SEQ ID NO: 814079 - protein, 622 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 814080 - protein, 659 aa, Homo sapiens
STLFTLAKMMPGCEIYFLNMESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 814081 - protein, 640 aa, Homo sapiens; identical to SEQ ID NO: 814074

SEQ ID NO: 814082 - protein, 526 aa, Homo sapiens
MNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 814083 - protein, 504 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKCCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 814084 - protein, 579 aa, Homo sapiens
PRASSIKQCLERERWRTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 814085 - protein, 564 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRITSTCKQSITLRCPGEKSSYGLPPPLTTHPR

SEQ ID NO: 814086 - protein, 526 aa, Homo sapiens
GVRGPRGGKVFARQSELQEDGRKEAGGEEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 814087 - protein, 423 aa, Homo sapiens
FERPPGYVNNEGPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 814088 - protein, 616 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLGEYLGSCWCLTEELHKAVFAVFIIEALQR

SEQ ID NO: 814089 - protein, 343 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGKEAWHECLRVFGVS

SEQ ID NO: 814090 - protein, 271 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPSPHTPDDELLP

SEQ ID NO: 814091 - protein, 271 aa, Homo sapiens; identical to SEQ ID NO: 814090

SEQ ID NO: 814092 - protein, 161 aa, Homo sapiens [sequence omitted]

SEQ ID NO: 814093 - protein, 272 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPSPHTPDDELLPW

SEQ ID NO: 814094 - protein, 176 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQEATAF

SEQ ID NO: 814095 - protein, 116 aa, Homo sapiens
RFVWTSRLECPPPSPPPLQSSAQVRARAVGAAPAEEAPGCPASRGTAAPGAGTPSPTVPVTRRLEVSVYPPDLLPRRPPQFPPFGPFRLFPVEPAALEFPSHTPPVILETSTAGHL

SEQ ID NO: 814096 - protein, 1098 aa, Homo sapiens
MPPRQPPRQAGGGLSREFGKLLPALSHSPLGGLGSGSGSVAPGQGRAGAMGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 814097 - protein, 1174 aa, Homo sapiens
MPPRQPPRQAGGGLSREFGKLLPALSHSPLGGLGSGSGSVAPGQGRAGAMGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPGELCLRPLFTLKFPGPLTPTLSSAPFLKFLGAVLANSNRGRCLLTSTSLSVETRRGYGRKDPDLGLAVRGDFLTSSDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 814098 - protein, 714 aa, Homo sapiens
MPPRQPPRQAGGGLSREFGKLLPALSHSPLGGLGSGSGSVAPGQGRAGAMGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGTSPA

SEQ ID NO: 814099 - protein, 741 aa, Homo sapiens
SSSDPALPLCPPQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 814100 - protein, 604 aa, Homo sapiens
SQRVLRLGKSMQRTHILALGHQFPVSRLQRSPNSIDPTFTLGRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 814101 - protein, 398 aa, Homo sapiens
DLTTRLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 814102 - protein, 1098 aa, Homo sapiens; identical to SEQ ID NO: 814096

SEQ ID NO: 814103 - protein, 1098 aa, Homo sapiens; identical to SEQ ID NO: 814096

SEQ ID NO: 814104 - protein, 1098 aa, Homo sapiens; identical to SEQ ID NO: 814096

SEQ ID NO: 814105 - protein, 1098 aa, Homo sapiens; identical to SEQ ID NO: 814096

SEQ ID NO: 814106 - protein, 1086 aa, Homo sapiens
MPPRQPPRQAGGGLSREFGKLLPALSHSPLGGLGSGSGSVAPGQGRAGAMGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAME

SEQ ID NO: 814107 - protein, 933 aa, Homo sapiens
MPPRQPPRQAGGGLSREFGKLLPALSHSPLGGLGSGSGSVAPGQGRAGAMGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLEVRS

SEQ ID NO: 814108 - protein, 762 aa, Homo sapiens
MPPRQPPRQAGGGLSREFGKLLPALSHSPLGGLGSGSGSVAPGQGRAGAMGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGVR

SEQ ID NO: 814109 - protein, 73 aa, Homo sapiens
MPGFALPLRLDDLLVGAPLLMDRTPDGRPQEVGRVYVYLQHPAGIEPTPTLTLTGHDEFGRFGSSLTPLGDLD

SEQ ID NO: 814110 - protein, 218 aa, Homo sapiens
ALAEEVVFRPPSRSKRGTGVAASKCFRWIPRDCRRCGLCLPTWSGKMFYHISLEHEILLHPRYFGPNLLNTVKQKLFTEVEGTCTGKYGFVIAVTTIDNIGAGVIQPGRGFVLYPVKYKAIVFRPFKGEVVDAVVTQVNKVGLFTEIGPMSCFISRHSIPSEMEFDPNSNPPCYKTMDEDIVIQQDDEIRLKIVGTRVDKNDIFAIGSLMDDYLGLVS

SEQ ID NO: 814111 - protein, 218 aa, Homo sapiens; identical to SEQ ID NO: 814110

SEQ ID NO: 814112 - protein, 869 aa, Homo sapiens
MLYFSLFWAARPLQRCGQLVRMAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNPKTGLIDYNQLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEHGRHLGNEAHRLKVTLLPPTWASEIESLSIFWCGREDLSLRARARYESPFPEFVTEKIFSFSFFWYQDLEGGPRHFLFEPLSSSQCQRRVLFLGEVEECPSEPVAGRGGEAPSFLFLSNKMLTCKKKKKKKKNQTMSEVWTLPAYLVWEDVLPCEQGSGWRQGLGGKEEQGQAPARDSPCRPITCQRLAWSPSHFSPQISLEHEILLHPRYFGPNLLNTVKQKLFTEVEGTCTGKYGFVIAVTTIDNIGAGVIQPGRGFVLYPVKYKAIVFRPFKGEVVDAVVTQVNKVGLFTEIGPMSCFISRHSIPSEMEFDPNSNPPCYKTMDEDIVIQQDDEIRLKIVGTRVDKNDIFAIGSLMDDYLGLVS

SEQ ID NO: 814113 - protein, 511 aa, Homo sapiens
GTRFRVAMLYFSLFWAARPLQRCGQLVRMAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNPKTGLIDYNQLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 814114 - protein, 511 aa, Homo sapiens; identical to SEQ ID NO: 814113

SEQ ID NO: 814115 - protein, 511 aa, Homo sapiens; identical to SEQ ID NO: 814113

SEQ ID NO: 814116 - protein, 511 aa, Homo sapiens; identical to SEQ ID NO: 814113

SEQ ID NO: 814117 - protein, 511 aa, Homo sapiens; identical to SEQ ID NO: 814113

SEQ ID NO: 814118 - protein, 511 aa, Homo sapiens; identical to SEQ ID NO: 814113

SEQ ID NO: 814119 - protein, 218 aa, Homo sapiens; identical to SEQ ID NO: 814110

SEQ ID NO: 814120 - protein, 511 aa, Homo sapiens; identical to SEQ ID NO: 814113

SEQ ID NO: 814121 - protein, 511 aa, Homo sapiens; identical to SEQ ID NO: 814113

SEQ ID NO: 814122 - protein, 425 aa, Homo sapiens
MGPRRLLLVAACFSLCGPLLSARTRARRPESKATNATLDPRSFLLRNPNDKYEPFWEDEEKNESGLTEYRLVSINKSSPLQKQLPAFISEDASGYLTSSWLTLFVPSVYTGVFVVSLPLNIMAIVVFILKMKVKKPAVVYMLHLATADVLFVSVLPFKISYYFSGSDWQFGSELCRFVTAAFYCNMYASILLMTVISIDRFLAVVYPMQSLSWRTLGRASFTCLAIWALAIAGVVPLLLKEQTIQVPGLNITTCHDVLNETLLEGYYAYYFSAFSAVFFFVPLIISTVCYVSIIRCLSSSAVANRSKKSRALFLSAAVFCIFIICFGPTNVLLIAHYSFLSHTSTTEAAYFAYLLCVCVSSISCCIDPLIYYYASSECQRYVYSILCCKESSDPSSYNSSGQLMASKMDTCSSNLNNSIYKKLLT

SEQ ID NO: 814123 - protein, 425 aa, Homo sapiens; identical to SEQ ID NO: 814122

SEQ ID NO: 814124 - protein, 425 aa, Homo sapiens; identical to SEQ ID NO: 814122

SEQ ID NO: 814125 - protein, 425 aa, Homo sapiens; identical to SEQ ID NO: 814122

SEQ ID NO: 814126 - protein, 425 aa, Homo sapiens; identical to SEQ ID NO: 814122

SEQ ID NO: 814127 - protein, 102 aa, Homo sapiens
MGPRRLLLVAACFSLCGPLLSARTRARRPVTFRWGVPPPSRAQPMPLWTRSWRVQPACHGVLDMEEDGAEAPWGSLQSCVALVIVFLPGPPPKRKALTLLHQ

SEQ ID NO: 814128 - protein, 114 aa, Homo sapiens
IDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKVGD

SEQ ID NO: 814129 - protein, 840 aa, Homo sapiens
IDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGTANSVPECISLTSLEDPVILSKIRQNLKEKHARHIADLRAYYESEINSLKQKLEAKEISGVEDWKITNQILVDRCGQLDSALHEATSRVRTLENKNNLLEIEVNDLRERFSAASSASKILQERIEEMRTSSKEKDNTIIRLKSRLQDLEEAFENAYKLSDDKEAQLKQENKMFQDLLGEYESLGKEHRRVKDALNTTENKLLDAYTQISDLKRMISKLEAQVKQVEHENMLSLRHNSRIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPTKREIMLTPVTVAYSPKRSPKENLSPGFSHLLSKNESSPIRFDILLDDLDTVPVSTLQRTNPRKQLQFLPLDDSEAITMLIIALALNRCQME

SEQ ID NO: 814130 - protein, 840 aa, Homo sapiens; identical to SEQ ID NO: 814129

SEQ ID NO: 814131 - protein, 840 aa, Homo sapiens; identical to SEQ ID NO: 814129

SEQ ID NO: 814132 - protein, 840 aa, Homo sapiens; identical to SEQ ID NO: 814129

SEQ ID NO: 814133 - protein, 962 aa, Homo sapiens
IDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGTANSVPECISLTSLEDPVILSKIRQNLKEKHARHIADLRAYYESEINSLKQKLEAKEISGVEDWKITNQILVDRCGQLDSALHEATSRVRTLENKNNLLEIEVNDLRERFSAASSASKILQERIEEMRTSSKEKDNTIIRLKSRLQDLEEAFENAYKLSDDKEAQLKQENKMFQDLLGEYESLGKEHRRVKDALNTTENKLLDAYTQISDLKRMISKLEAQVKQVEHENMLSLRHNSRIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPTKREIMLTPVTVAYSPKRSPKENLSPGFSHLLSKNESSPIRFDILLDDLDTVPVSTLQRTNPRKQLQFLPLDDSEEKTYSEKATDNHVNHSSCPEPVPNGVKKVSVRTAWEKNKSVSYEQCKPVSVTPQGNDFEYTAKIRTLAETERFFDELTKEKDQIEAALSRMPSPGGRITLQTRLNQEALEDRLERINRELGSVRMTLKKFHVLRTSANL

SEQ ID NO: 814134 - protein, 940 aa, Homo sapiens
IDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGLRQNLKEKHARHIADLRAYYESEINSLKQKLEAKEISGVEDWKITNQILVDRCGQLDSALHEATSRVRTLENKNNLLEIEVNDLRERFSAASSASKILQERIEEMRTSSKEKDNTIIRLKSRLQDLEEAFENAYKLSDDKEAQLKQENKMFQDLLGEYESLGKEHRRVKDALNTTENKLLDAYTQISDLKRMISKLEAQVKQVEHENMLSLRHNSRIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPTKREIMLTPVTVAYSPKRSPKENLSPGFSHLLSKNESSPIRFDILLDDLDTVPVSTLQRTNPRKQLQFLPLDDSEEKTYSEKATDNHVNHSSCPEPVPNGVKKVSVRTAWEKNKSVSYEQCKPVSVTPQGNDFEYTAKIRTLAETERFFDELTKEKDQIEAALSRMPSPGGRITLQTRLNQEALEDRLERINRELGSVRMTLKKFHVLRTSANL

SEQ ID NO: 814135 - protein, 288 aa, Homo sapiens [sequence omitted]

SEQ ID NO: 814136 - protein, 751 aa, Homo sapiens
IDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGTANSVPECISLTSLEDPVILSKIRQNLKEKHARHIADLRAYYESEINSLKQKLEAKEISGVEDWKITNQILVDRCGQLDSALHEATSRVRTLENKNNLLEIEVNDLRERFSAASSASKILQERIEEMRTSSKEKDNTIIRLKSRLQDLEEAFENAYKLSDDKEAQLKQENKMFQDLLGEYESLGKEHRRVKDALNTTENKLLDAYTQISDLKRMISKLEAQVKQVEHENMLSLRHNSRIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPTKREIMLTPVTVAYSPKRSPKENLSPGFSHLLSKNESSPIRKNLF

SEQ ID NO: 814137 - protein, 930 aa, Homo sapiens
IDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGTANSVPECISLTSLEDPVILSKIRQNLKEKHARHIADLRAYYESEINSLKQKLEAKEISGVEDWKITNQILVDRCGQLDSALHEATSRVRTLENKNNLLEIEVNDLRERFSAASSASKILQERIEEMRTSSKEKDNTIIRLKSRLQDLEEAFENAYKLSDDKEAQLKQENKMFQDLLGEYESLGKEHRRVKDALNTTENKLLDAYTQISDLKRMISKLEAQVKQVEHENMLSLRHNSRIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPTKREIMLTPVTVAYSPKRSPKENLSPGFSHLLSKNESSPIRFDILLDDLDTVPVSTLQRTNPRKQLQFLPLDDSEEKTYSEKATDNHVNHSSCPEPVPNGVKKVSVRTAWEKNKSVSYEQCKPVSVTPQGNDFEYTAKIRTLAETERFFDELTKEKDQIEAALSRMPSPGGRITLQTRLNQL

SEQ ID NO: 814138 - protein, 959 aa, Homo sapiens
IDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGTANSVPECISLTSLEDPVILSKIRQNLKEKHARHIADLRAYYESEINSLKQKLEAKEISGVEDWKITNQILVDRCGQLDSALHEATSRVRTLENKNNLLEIEVNDLRERFSAASSASKILQERIEEMRTSSKEKDNTIIRLKSRLQDLEEAFENAYKLSDDKEAQLKQENKMFQDLLGEYESLGKEHRRVKDALNTTENKLLDAYTQISDLKRMISKLEAQVKQVEHENMLSLRHNSRIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPTKREIMLTPVTVAYSPKRSPKENLSPGFSHLLSKNESSPIRFDILLDDLDTVPVSTLQRTNPRKQLQFLPLDDSEEKTYSEKATDNHVNHSSCPEPVPNGVKKVSVRTAWEKNKSVSYEQCKPVSVTPQGNDFEYTAKIRTLAETERFFDELTKEKDQIEAALSRMPSPGGRITLQTRLNQTPQICEESSHKCAFAGHYVPCHLYDYRFQG

SEQ ID NO: 814139 - protein, 938 aa, Homo sapiens
IDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGTANSVPECISLTSLEDPVILSKIRQNLKEKHARHIADLRAYYESEINSLKQKLEAKEISGVEDWKITNQILVDRCGQLDSALHEATSRVRTLENKNNLLEIEVNDLRERFSAASSASKILQERIEEMRTSSKEKDNTIIRLKSRLQDLEEAFENAYKLSDDKEAQLKQENKMFQDLLGEYESLGKEHRRVKDALNTTENKLLDAYTQISDLKRMISKLEAQVKQVEHENMLSLRHNSRIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPTKREIMLTPVTVAYSPKRSPKENLSPGFSHLLSKNESSPIRFDILLDDLDTVPVSTLQRTNPRKQLQFLPLDDSEEKTYSEKATDNHVNHSSCPEPVPNGVKKVSVRTAWEKNKSVSYEQCKPVSVTPQGNDFEYTAKIRTLAETERFFDELTKEKDQIEAALSRMPSPGGRITLQTRLNQVRCLSLNLL

SEQ ID NO: 814140 - protein, 377 aa, Homo sapiens
IDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGTANSVPECISLTSLEDPVILSKYVFQ

SEQ ID NO: 814141 - protein, 355 aa, Homo sapiens
IDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGLGRI

SEQ ID NO: 814142 - protein, 234 aa, Homo sapiens
IDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVKLSTFCRVNVNNAS

SEQ ID NO: 814143 - protein, 600 aa, Homo sapiens
HKSPSYQIKEGDTINVDVTCPGATLALAMIYLKTNNRSIADWLRAPDTMYLLDFVKPEFLLLRTLARCLILWDDILPNSKWVDSNVPQIIRENSISLSEIELPCSEDLNLETLSQAHVYIIAGACLSLGFRFAGSENLSAFNCLHKFAKDFMTYLSAPNASVTGPHNLETCLSVVLLSLAMVMAGSGNLKVLQLCRFLHMKTGGEMNYGFHLAHHMALGLLFLGGGRYSLSTSNSSIAALLCALYPHFPAHSTDNRYHLQALRHLYVLAAEPRLLVPVDVDTNTPCYALLEVTYKGTQWYEQTKEELMAPTLLPELHLLKQIKVKGPRYWELLIDLSKGTQHLKSILSKDGVLYVKLRAGQLSYKEDPMGWQSLLAQTVANRNSEARAFKPETISAFTSDPALLSFAEYFCKPTVNMGQKQEILDLFSSVLYECVTQETPEMLPAYIAMDQAIRRLGRREMSETSELWQIKLVLEFFSSRSHQERLQNHPKRGLFMNSEFLPVVKCTIDNTLDQWLQVGGDMCVHAYLSGQPLEESQLSMLACFLVYHSVPAPQHLPPIGLEGSTSFAELLFKFKQLKMPVRALLRLAPLLLGNPQPMVM

SEQ ID NO: 814144 - protein, 600 aa, Homo sapiens; identical to SEQ ID NO: 814143

SEQ ID NO: 814145 - protein, 420 aa, Homo sapiens
MVMAGSGNLKVLQLCRFLHMKTGGEMNYGFHLAHHMALGLLFLGGGRYSLSTSNSSIAALLCALYPHFPAHSTDNRYHLQALRHLYVLAAEPRLLVPVDVDTNTPCYALLEVTYKGTQWYEQTKEELMAPTLLPELHLLKQIKVKGPRYWELLIDLSKGTQHLKSILSKDGVLYVKLRAGQLSYKEDPMGWQSLLAQTVANRNSEARAFKPETISAFTSDPALLSFAEYFCKPTVNMGQKQEILDLFSSVLYECVTQETPEMLPAYIAMDQAIRRLGRREMSETSELWQIKLVLEFFSSRSHQERLQNHPKRGLFMNSEFLPVVKCTIDNTLDQWLQVGGDMCVHAYLSGQPLEESQLSMLACFLVYHSVPAPQHLPPIGLEGSTSFAELLFKFKQLKMPVRALLRLAPLLLGNPQPMVM

SEQ ID NO: 814146 - protein, 573 aa, Homo sapiens
HKSPSYQIKEGDTINVDVTCPGATLALAMIYLKTNNRSIADWLRAPDTMYLLDFVKPEFLLLRTLARCLILWDDILPNSKWVDSNVPQIIRENSISLSEIELPCSEDLNLETLSQAHVYIIAGACLSLGFRFAGSENLSAFNCLHKFAKDFMTYLSAPNASVTGPHNLETCLSVVLLSLAMVMAGSGNLKVLQLCRFLHMKTGGEMNYGFHLAHHMALGLLFLGGGRYSLSTSNSSIAALLCALYPHFPAHSTDNRYHLQALRHLYVLAAEPRLLVPVDVDTNTPCYALLEVTYKGTQWYEQTKEELMAPTLLPELHLLKQIKVKGPRYWELLIDLSKGTQHLKSILSKDGVLYVKLRAGQLSYKEDPMGWQSLLAQTVANRNSEARAFKPETISAFTSDPALLSFAEYFCKPTVNMGQKQEILDLFSSVLYECVTQETPEMLPAYIAMDQAIRRLGRREMSETSELWQIKLVLEFFSSRSHQERLQNHPKRGLFMNSEFLPVVKCTIDNTLDQWLQVGGDMCVHAYLSGQPLEESQLSMLACFLVYHSVPAPQHLPPIGLEGLLKDLAGDSG

SEQ ID NO: 814147 - protein, 900 aa, Homo sapiens
MATCAVEVFGLLEDEENSRIVRVRVIAGIGLAKKDILGASDPYVRVTLYDPMNGVLTSVQTKTIKKSLNPKWNEEILFRVHPQQHRLLFEVFDENRLTRDDFLGQVDVPLYPLPTENPRLERPYTFKDFVLHPRSHKSRVKGYLRLKMTYLPKTSGSEDDNAEQAEELEPGWVVLDQPDAACHLQQQQEPSPLPPGWEERQDILGRTYYVNHESRRTQWKRPTPQDNLTDAENGNIQLQAQRAFTTRRQISEETESVDNQESSENWEIIREDEATMYSSQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 814148 - protein, 286 aa, Homo sapiens
MATCAVEVFGLLEDEEALLIADFSSHRLPAEPVDLKENSAKELEKTTLKFIWNQKRARIAKSILSQKNKAGGITLPDFKLYYKATVTKTAWYWYQNRDIDQWNRTEPSEIMPHIYNYLIFDKPEKNKQWGKDSLFNKWCWENWLAICRKLKLDPFLTPYTKINSRWIKDLNVRPKTIKTLEENLGITIQDIGVGKDFMSKTPKAMATKAKIDKWDLIKLKSFCTAKETTIRVNRQPTTWEKIFATYSSDKGLISRIYNELKQIYKKKTNNPIKKWAKDMNRHFSKE

SEQ ID NO: 814149 - protein, 356 aa, Homo sapiens [sequence omitted]

SEQ ID NO: 814150 - protein, 883 aa, Homo sapiens
MATCAVEVFGLLEDEENSRIVRVRVIAGIGLAKKDILGASDPYVRVTLYDPMNGVLTSVQTKTIKKSLNPKWNEEILFRVHPQQHRLLFEVFDENRLTRDDFLGQVDVPLYPLPTENPRLERPYTFKDFVLHPRSHKSRVKGYLRLKMTYLPKTSGSEDDNAEQAEELEPGWVVLDQPDAACHLQQQQEPSPLPPGWEERQDILGRTYYVNHESRRTQWKRPTPQDNLTDAENGNIQLQAQRAFTTRRQISEETESVDNQESSENWEIIREDEATMYSSQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKVQMDHSHLQLNSGVLLKSCQELIPVLIAWTCHLMNHLKNYGINFRWQLKTPRALMELIRLQITICSVFTAIVL

SEQ ID NO: 814151 - protein, 900 aa, Homo sapiens; identical to SEQ ID NO: 814147

SEQ ID NO: 814152 - protein, 118 aa, Homo sapiens
MATCAVEVFGLLEDEENSRIVRVRVIAGIGLAKKDILGASDPYVRVTLYDPMNGVLTSVQTKTIKKSLNPKWNEEILFRKIILEGPKKLFTVFALGVGQRFILSSTGFFLKCLTKTDW

SEQ ID NO: 814153 - protein, 67 aa, Homo sapiens
SRFSSSSSTVACPGRGRARPVCWKRSEMATCAVEVFGLLEDEENSRIVRVRVIAGIGLAKKDILGAR

SEQ ID NO: 814154 - protein, 662 aa, Homo sapiens
GVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPLNPVPGSSSFSKVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 814155 - protein, 628 aa, Homo sapiens
GVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPLNPVPGSSSFSKVTVSAADSFPDGLVHPPTSAAAPVTPLRPPGLGSASLHGGGPARRRSSDKFCSPISSELAQNHEFYKNADVRPPFTYASLIRQNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 814156 - protein, 253 aa, Homo sapiens
RKDREGRAEPERAKQPTKCHAPAGLRRAAVGPARWEDARELRDAGRRGRAAPAGGGGPGLRPERAPCPARADGPEPARSGRAGQVNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 814157 - protein, 662 aa, Homo sapiens; identical to SEQ ID NO: 814154

SEQ ID NO: 814158 - protein, 662 aa, Homo sapiens; identical to SEQ ID NO: 814154

SEQ ID NO: 814159 - protein, 130 aa, Homo sapiens [sequence omitted]

SEQ ID NO: 814160 - protein, 662 aa, Homo sapiens; identical to SEQ ID NO: 814154

SEQ ID NO: 814161 - protein, 662 aa, Homo sapiens; identical to SEQ ID NO: 814154

SEQ ID NO: 814162 - protein, 150 aa, Homo sapiens
RKDREGRAEPERAKQPTKCHAPAGLRRAAVGPARWEDARELRDAGRRGRAAPAGGGGPGLRPERAPCPARADGPEPARSGRAGQVALRPEAGPGPGAQGKARLDPGSTPTSSLQASLQSSHPPSAPLPLQSPSAPLPCPPLPPPPHQLNG

SEQ ID NO: 814163 - protein, 86 aa, Homo sapiens
KKKAFHVSKETWSVFFLALSEFPPKIKSTNPGIFIRDVAKKLCEVWDTLNVSEKQPCITKPVKLREKYEKDVGEVKSALCHPEKST

SEQ ID NO: 814164 - protein, 98 aa, Homo sapiens
ELRTPPTSPTVPDYARPSPTSPTAPTSPTAGPLSGFTSSCQWQKIMPHKLFTWFTLESISSRGLVWLQIIHKCPLFSAPKELLSLFLTKQVQISPRLC

SEQ ID NO: 814165 - protein, 381 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGEIALLMNRPRAATVVARGPLKCVKLDRPRFERVLGPCSDILKRNIQQYNSFVSLSV

SEQ ID NO: 814166 - protein, 300 aa, Homo sapiens
REGVERREKRQRRQGRPEGEWGGQRSGGTRGKRTIAARRESEEQEEEQRRPKTPREGQRTMESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMYGSP

SEQ ID NO: 814167 - protein, 223 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDYVPEVSAWIRRLLSKILNLGNAELLDSESVNFRYQLKWDE

SEQ ID NO: 814168 - protein, 242 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDILMHVSVSFIDGRCGSAVIKGYFCDESGKTDVMVTDGHRSGRGAGQRLDGTGTTLEKWIGLRHISSGRRENYNQYARISTHKEGKKKQKVEEIV

SEQ ID NO: 814169 - protein, 107 aa, Homo sapiens
MESGSTAASEEARSLRECELYVQKHNIQALLKDSIVQLCTARPERPMAFLREYFERLEKMRFLLLHPTQWLKVGGDEVLSALRSTRRKMRHPMLERLYHKITRLAAV

SEQ ID NO: 814170 - protein, 381 aa, Homo sapiens; identical to SEQ ID NO: 814165

SEQ ID NO: 814171 - protein, 381 aa, Homo sapiens; identical to SEQ ID NO: 814165

SEQ ID NO: 814172 - protein, 441 aa, Homo sapiens
REGVERREKRQRRQGRPEGEWGGQRSGGTRGKRTIAARRESEEQEEEQRRPKTPREGQRTMESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGEIALLMNRPRAATVVARGPLKCVKLDRPRFERVLGPCSDILKRNIQQYNSFVSLSV

SEQ ID NO: 814173 - protein, 381 aa, Homo sapiens; identical to SEQ ID NO: 814165

SEQ ID NO: 814174 - protein, 381 aa, Homo sapiens; identical to SEQ ID NO: 814165

SEQ ID NO: 814175 - protein, 381 aa, Homo sapiens; identical to SEQ ID NO: 814165

SEQ ID NO: 814176 - protein, 381 aa, Homo sapiens; identical to SEQ ID NO: 814165

SEQ ID NO: 814177 - protein, 349 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGMYEFPHNKYMVSLSHLSVRYCSLP

SEQ ID NO: 814178 - protein, 229 aa, Homo sapiens
MFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGEIALLMNRPRAATVVARGPLKCVKLDRPRFERVLGPCSDILKRNIQQYNSFVSLSV

SEQ ID NO: 814179 - protein, 336 aa, Homo sapiens
STLGGQGGWIISAQEFEITLRNVAKPCLYKNYKKLAGRGGACLWSQPRRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGEIALLMNRPRAATVVARGPLKCVKLDRPRFERVLGPCSDILKRNIQQYNSFVSLSV

SEQ ID NO: 814180 - protein, 260 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILVGIN

SEQ ID NO: 814181 - protein, 252 aa, Homo sapiens
MRITWKNVRFTSDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGEIALLMNRPRAATVVARGPLKCVKLDRPRFERVLGPCSDILKRNIQQYNSFVSLSV

SEQ ID NO: 814182 - protein, 381 aa, Homo sapiens; identical to SEQ ID NO: 814165

SEQ ID NO: 814183 - protein, 146 aa, Homo sapiens
MGSTLRKRKMYEEFLSKVSILESLDKWERLTVADALEPVQFEDGQKIVVQGEPGDEFFIILEGSAAVLQRRSENEEFVEVGRLGPSDYFGEIALLMNRPRAATVVARGPLKCVKLDRPRFERVLGPCSDILKRNIQQYNSFVSLSV

SEQ ID NO: 814184 - protein, 170 aa, Homo sapiens
TEHYDMFDSSSYPTDLGETPIENPHGSTLRKRKMYEEFLSKVSILESLDKWERLTVADALEPVQFEDGQKIVVQGEPGDEFFIILEGSAAVLQRRSENEEFVEVGRLGPSDYFGEIALLMNRPRAATVVARGPLKCVKLDRPRFERVLGPCSDILKRNIQQYNSFVSLSV

SEQ ID NO: 814185 - protein, 381 aa, Homo sapiens; identical to SEQ ID NO: 814165

SEQ ID NO: 814186 - protein, 381 aa, Homo sapiens; identical to SEQ ID NO: 814165

SEQ ID NO: 814187 - protein, 164 aa, Homo sapiens
GTSRTGQKNFQIPFKRLYNHGVSVKVGERDATHPERPVNVIHAVYMRIWYILTSCLSPRGDGQKIVVQGEPGDEFFIILEGSAAVLQRRSENEEFVEVGRLGPSDYFGEIALLMNRPRAATVVARGPLKCVKLDRPRFERVLGPCSDILKRNIQQYNSFVSLSV

SEQ ID NO: 814188 - protein, 381 aa, Homo sapiens; identical to SEQ ID NO: 814165

SEQ ID NO: 814189 - protein, 160 aa, Homo sapiens
PPGCRIRHEVSFIEEETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRR

SEQ ID NO: 814190 - protein, 369 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGEIALLMNRPRAATVVARGPLKCVKLDRPRFERVLGLAICKGYRA

SEQ ID NO: 814191 - protein, 349 aa, Homo sapiens; identical to SEQ ID NO: 814177

SEQ ID NO: 814192 - protein, 337 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGHLIISRRSIPLG

SEQ ID NO: 814193 - protein, 349 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVECVKLDRPRFERVLGPCSDILKRNIQQYNSFVSLSV

SEQ ID NO: 814194 - protein, 252 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATIEKISWAWWHTPIIPALWEAEVGGSPEVESSRPAWPTR

SEQ ID NO: 814195 - protein, 205 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVRFTNIKNMLILKANVLIASEQ

SEQ ID NO: 814196 - protein, 161 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAIGPRGFAST

SEQ ID NO: 814197 - protein, 126 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYRHAA

SEQ ID NO: 814198 - protein, 136 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKHQETITHEVVTQIGQI

SEQ ID NO: 814199 - protein, 123 aa, Homo sapiens
VSSRNADWLRPGRFRWSCRLAAIAEWSGAGSKALRELGTPPPRTRSLAPAAARPQRTMESGSTAASEEARSLRECELYVQKHNIQALLKDSIVQLCTARPERPMAFLREYFERLEKVKINVGR

SEQ ID NO: 814200 - protein, 121 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKVLHSCKLLYFPYLQRQVATGIAASCLFIY

SEQ ID NO: 814201 - protein, 161 aa, Homo sapiens; identical to SEQ ID NO: 814196

SEQ ID NO: 814202 - protein, 73 aa, Homo sapiens
PPSPPRAAASSLTLPHFLKDNGSILLGSAIVSSAGPGSSCKPVVFLSTFDDSSLLAVAFPLHSGVIFPPTRRS

SEQ ID NO: 814203 - protein, 73 aa, Homo sapiens
KQIQNLQKAGTRTDSREDEISPPPPNPVVKGRRRRGAISAEVYTEEDAASYVRKVVLIFEYRGDAFGTHLVVI

SEQ ID NO: 814204 - protein, 471 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKYCDPDSYHRRDFW

SEQ ID NO: 814205 - protein, 471 aa, Homo sapiens; identical to SEQ ID NO: 814204

SEQ ID NO: 814206 - protein, 471 aa, Homo sapiens; identical to SEQ ID NO: 814204

SEQ ID NO: 814207 - protein, 471 aa, Homo sapiens; identical to SEQ ID NO: 814204

SEQ ID NO: 814208 - protein, 471 aa, Homo sapiens; identical to SEQ ID NO: 814204

SEQ ID NO: 814209 - protein, 465 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDPALSLTRTTALFLRPLVLSGPLLGFLRS

SEQ ID NO: 814210 - protein, 371 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLEHHQSDACDPASAGLDELPGADGRPPD

SEQ ID NO: 814211 - protein, 427 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLEHHQSDACDPTSAWPGACWEDVCFLLHLKAGNLSELGKTGKKSERNGGTWGKRMEDGLGAVRAKSRQGLPQGRLRALHTLTAA

SEQ ID NO: 814212 - protein, 329 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGLCPWGPDSGPKLYSGGSKLDKTRSKGWHPGTRGQRAEGTGTKGAHGERDIQGQPGVEKWHNGQRRGKRDNNTTGNHRHDKE

SEQ ID NO: 814213 - protein, 491 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEVKYCGAEIPRSNKKLLPSSKEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKYCDPDSYHRRDFW

SEQ ID NO: 814214 - protein, 367 aa, Homo sapiens
MQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKYCDPDSYHRRDFW

SEQ ID NO: 814215 - protein, 387 aa, Homo sapiens
MQYKAMQAAGQIPATALLPTMTPDGLAVTPTPVPVVGSQMTRQARRLYVGNIPFGITEVKYCGAEIPRSNKKLLPSSKEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKYCDPDSYHRRDFW

SEQ ID NO: 814216 - protein, 198 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQPLLLP

SEQ ID NO: 814217 - protein, 393 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEVKYCGAEIPRSNKKLLPSSKEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQVSPRSLAAAASVLPCPALLPSHGLPSSGDGAGGGQPEAVPCVWARPCPMVLAFSRLLI

SEQ ID NO: 814218 - protein, 184 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEVKYCGAEIPRSNKKFATIVEGK

SEQ ID NO: 814219 - protein, 289 aa, Homo sapiens
VPRDPPPHHPNRTDICLFGFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKYCDPDSYHRRDFW

SEQ ID NO: 814220 - protein, 192 aa, Homo sapiens
APFIPLAAFVWHNLLRPSARPALFFFHFPHPESQVPRTRTSSPSLSLPLIHLVSVLLPFSVPEAGRSRGTHGKSRSCPRRVRPSRSGGGRSRSSLIGGVSKWHLRKEPKHGLELNPRRGPRARSGNLRKEPKAGTVRIVGSGRLLGQGRRRRSEQVRGRSQRLGRIELLEEPELAEGTGRSGTRGHTETSER

SEQ ID NO: 814221 - protein, 135 aa, Homo sapiens [sequence omitted]

SEQ ID NO: 814222 - protein, 30 aa, Homo sapiens
MAFDGIIFQGQSLKIRRPHDYQPLPGMSEN

SEQ ID NO: 814223 - protein, 451 aa, Homo sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 814224 - protein, 503 aa, Homo sapiens
SKRPRGAARGCAWAPLLRRGVGEGSGAPSAPRRPTPPGSAPLLVPGGRRAAVMKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 814225 - protein, 503 aa, Homo sapiens
MSEARGEPGSGPEAGARFFCTAGRGLEPFVMREVRARLAATQVEYISGKVFFTTCSDLNMLKKLKSAERLFLLIKKQFPLIISSVSKGKIFNEMQRLINEDPGSWLNAISIWKNLLELDAKKEKLSQRDDNQLKRKVGENEIIAKKLKIEQMQKIEENRDCQLEKQIKEETLEQRDFTTKSEKFQEEEFQNDIEKAIDTHNQNDLTFRVSCRCSGTIGKAFTAQEVGKVIGIAIMKHFGWKADLRNPQLEIFIHLNDIYSVVGIPVFRVSLASRAYIKTAGLRSTIAWAMASLADIKAGAFVLDPMCGLGTILLEAAKEWPDVYYVGADVSDSQLLGTWDNLKAAGLEDKIELLKISVIELPLPSESVDIIISDIPFGKKFKLGKDIKSILQEMERVLHVGGTIVLLLSEDHHRRLTDCKESNIPFNSKDSHTDEPGIKKCLNPEEKTGAFKTASTSFEASNHKFLDRMSPFGSLVPVECYKVSLGKTDAFICKYKKSHSSGL

SEQ ID NO: 814226 - protein, 254 aa, Homo sapiens
MSEARGEPGSGPEAGARFFCTAGRGLEPFVMREVRARLAATQVEYISGKVFFTTCSDLNMLKKLKSAERLFLLIKKQFPLIISSVSKGKIFNEMQRLINEDPGSWLNAISIWKNLLELDAKKEKLSQRDDNQLKRKVGENEIIAKKLKIEQMQKIEENRDCQLEKQIKEETLEQRDFTTKSEKFQEEEFQNDIEKAIDTHNQNDLTFRVSCRCSGTIGKAFTAQEVGKVIGIAIMKHFGWKADLRNPQLEILLL

SEQ ID NO: 814227 - protein, 543 aa, Homo sapiens
MSEARGEPGSGPEAGARFFCTAGRGLEPFVMREVRARLAATQVEYISGKVFFTTCSDLNMLKKLKSAERLFLLIKKQFPLIISSVSKGKIFNEMQRLINEDPGSWLNAISIWKNLLELDAKKEKLSQRDDNQLKRKVGENEIIAKKLKIEQMQKIEENRDCQLEKQIKEETLEQRDFTTKSEKFQEEEFQNDIEKAIDTHNQNDLTFRVSCRCSGTIGKAFTAQEVGKVIGIAIMKHFGWKADLRNPQLEIFIHLNDIYSVVGIPVFRVSLASRAYIKTAGLRSTIAWAMASLADIKVPYGSDETWLCTEDSASSVDISSGGCLFSPISSTTGPDSGAGAFVLDPMCGLGTILLEAAKEWPDVYYVGADVSDSQLLGTWDNLKAAGLEDKIELLKISVIELPLPSESVDIIISDIPFGKKFKLGKDIKSILQEMERVLHVGGTIVLLLSEDHHRRLTDCKESNIPFNSKDSHTDEPGIKKCLNPEEKTGAFKTASTSFEASNHKFLDRMSPFGSLVPVECYKVSLGKTDAFICKYKKSHSSGL

SEQ ID NO: 814228 - protein, 244 aa, Homo sapiens
MALTETWLCTEDSASSVDISSGGCLFSPISSTTGPDSGAGAFVLDPMCGLGTILLEAAKEWPDVYYVGADVSDSQLLGTWDNLKAAGLEDKIELLKISVIELPLPSESVDIIISDIPFGKKFKLGKDIKSILQEMERVLHVGGTIVLLLSEDHHRRLTDCKESNIPFNSKDSHTDEPGIKKCLNPEEKTGAFKTASTSFEASNHKFLDRMSPFGSLVPVECYKVSLGKTDAFICKYKKSHSSGL

SEQ ID NO: 814229 - protein, 543 aa, Homo sapiens; identical to SEQ ID NO: 814227

SEQ ID NO: 814230 - protein, 543 aa, Homo sapiens; identical to SEQ ID NO: 814227

SEQ ID NO: 814231 - protein, 272 aa, Homo sapiens
MSEARGEPGSGPEAGARFFCTAGRGLEPFVMREVRARLAATQVEYISGKVFFTTCSDLNMLKKLKSAERLFLLIKKQFPLIISSVSKGKIFNEMQRLINEDPGSWLNAISIWKNLLELDAKKEKLSQRDDNQLKRKVGENEIIAKKLKIEQMQKIEENRDCQLEKQIKEETLEQRDFTTKSEKFQEEEFQNDIEKAIDTHNQNDLTFRVSCRCSGTIGKAFTAQMSFVFGNPDTIVLSFWGFSSVQLCAYSVATLHRSCTWDCHQDLDCKCT

SEQ ID NO: 814232 - protein, 244 aa, Homo sapiens
MSEARGEPGSGPEAGARFFCTAGRGLEPFVMREVRARLAATQVEYISGKVFFTTCSDLNMLKKLKSAERLFLLIKKQFPLIISSVSKGKIFNEMQRLINEDPGSWLNAISIWKNLLELDAKKEKLSQRDDNQLKRKVGENEIIAKKLKIEQMQKIEENRDCQLEKQIKEETLEQRDFTTKSEKFQEEEFQNDIEKAIDTHNQNDLTFRVSCRCSGTIGKAFTAQVCLHPKVESVAQAGMQLHNL

SEQ ID NO: 814233 - protein, 220 aa, Homo sapiens
ATRYRSRYEAWWQHLLASSRPEPANERKMADNFSLHDALSGSGNPNPQGWPGAWGNQPAGAGGYPGASYPGAYPGQAPPGAYPGQAPPGAYHGAPGAYPGAPAPGVYPGPPSGPGAYPSSGQPSAPGAYPATGPYGAPAGPLIVPYNLPLPGGVVPRMLITILGTVKPNANRIALDFQRGNDVAFHFNPRFNENNRRVIVCNTKLDNNWGRERKTVGFPI

SEQ ID NO: 814234 - protein, 220 aa, Homo sapiens; identical to SEQ ID NO: 814233

SEQ ID NO: 814235 - protein, 202 aa, Homo sapiens
GRPQHLLASSRPEPANERKMADNFSLHDALSGSGNPNPQGWPGAWGNQPAGAGGYPGASYPGAYPGQAPPGAYPGQAPPGAYHGAPGAYPGAPAPGVYPGPPSGPGAYPSSGQPSAPGAYPATGPYGAPAGPLIVPYNLPLPGGVVPRMLITILGTVKPNANRIALDFQRGNDVAFHFNPRFNENNRRVIVCNTCVKVSCSL

SEQ ID NO: 814236 - protein, 143 aa, Homo sapiens
LVIQAVADNFSLHDALSGSGNPNPQGWPGAWGNQPAGAGGYPGASYPGAYPGQAPPGAYPGQAPPGAYHGAPGAYPGAPAPGVYPGPPSGPGAYPSSGQPSAPGAYPATGPYGAPAGPLIVLYNLPFLGGVVPRLLGLKGGTE

SEQ ID NO: 814237 - protein, 220 aa, Homo sapiens; identical to SEQ ID NO: 814233

SEQ ID NO: 814238 - protein, 220 aa, Homo sapiens; identical to SEQ ID NO: 814233

SEQ ID NO: 814239 - protein, 220 aa, Homo sapiens; identical to SEQ ID NO: 814233

SEQ ID NO: 814240 - protein, 220 aa, Homo sapiens; identical to SEQ ID NO: 814233

SEQ ID NO: 814241 - protein, 105 aa, Homo sapiens [sequence omitted]

SEQ ID NO: 814242 - protein, 211 aa, Homo sapiens
GRPQHLLASSRPEPANERKMADNFSLHDALSGSGNPNPQGWPGAWGNQPAGAGGYPGASYPGAYPGQAPPGAYPGQAPPGAYHGAPGAYPGAPAPGVYPGPPSGPGAYPSSGQPSAPGAYPATGPYGAPAGPLIVPYNLPLPGGVVPRMLITILGTVKPNANRIALDFQRGNDVAFHFNPRFNENNRRVIVCNTKLDNNWGRERKTVGFPI

SEQ ID NO: 814243 - protein, 224 aa, Homo sapiens
APAAPPRQQPSGASQRAGMHSKTPCGCFKPWKMADNFSLHDALSGSGNPNPQGWPGAWGNQPAGAGGYPGASYPGAYPGQAPPGAYPGQAPPGAYHGAPGAYPGAPAPGVYPGPPSGPGAYPSSGQPSAPGAYPATGPYGAPAGPLIVPYNLPLPGGVVPRMLITILGTVKPNANRIALDFQRGNDVAFHFNPRFNENNRRVIVCNTKLDNNWGRERKTVGFPI

SEQ ID NO: 814244 - protein, 209 aa, Homo sapiens
TKYSAALGIPSDSCCRKMADNFSLHDALSGSGNPNPQGWPGAWGNQPAGAGGYPGASYPGAYPGQAPPGAYPGQAPPGAYHGAPGAYPGAPAPGVYPGPPSGPGAYPSSGQPSAPGAYPATGPYGAPAGPLIVPYNLPLPGGVVPRMLITILGTVKPNANRIALDFQRGNDVAFHFNPRFNENNRRVIVCNTKLDNNWGRERKTVGFPI

SEQ ID NO: 814245 - protein, 105 aa, Homo sapiens [sequence omitted]

SEQ ID NO: 814246 - protein, 105 aa, Homo sapiens [sequence omitted]

SEQ ID NO: 814247 - protein, 156 aa, Homo sapiens
GRPQHLLASSRPEPANERKMADNFSLHDALSGSGNPNPQGWPGAWGNQPAGAYPSSGQPSAPGAYPATGPYGAPAGPLIVPYNLPLPGGVVPRMLITILGTVKPNANRIALDFQRGNDVAFHFNPRFNENNRRVIVCNTKLDNNWGRERKTVGFPI

SEQ ID NO: 814248 - protein, 158 aa, Homo sapiens
DGSASLYACMLSLEFPPPRAYPGQAPPGAYPGQAPPGAYHGAPGAYPGAPAPGAYPSSGQPSAPGAYPATGPYGAPAGPLIVPYNLPLPGGVVPRMLITILGTVKPNANRIALDFQRGNDVAFHFNPRFNENNRRVIVCNTKLDNNWGRERKTVGFPI

SEQ ID NO: 814249 - protein, 111 aa, Homo sapiens
MAWRMGEPACWGRGLPRGFLSCTGPYGAPAGPLIVPYNLPLPGGVVPRMLITILGTVKPNANRIALDFQRGNDVAFHFNPRFNENNRRVIVCNTKLDNNWGRERKTVGFPI

SEQ ID NO: 814250 - protein, 147 aa, Homo sapiens
ATRYRSRYEAWWQHLLASSRPEPANERKMADNFSLHDALSGSGNPNPQGWPGAWGNQPAGAGGYPGASYPGAYPGQAPPGAYPGQAPPGAYHGAPGAYPGAPAPGVYPGPPSGPGAYPSSGQPSAPGAYPALCLITCLCLGEWCLAC

SEQ ID NO: 814251 - protein, 196 aa, Homo sapiens
LHGIGLGTRLGGSTSSPAAVRSQPTSGKWQTIFRSMMRYLGLETQTLKDGLAHGGTSLLGQGATQGLPILGPTPGRHPQGLILDRHLQAPTMEHLELIPEHLHLESTQGHPAALGPTHLLDSQVPPEPTLLPRMLITILGTVKPNANRIALDFQRGNDVAFHFNPRFNENNRRVIVCNTKLDNNWGRERKTVGFPI

SEQ ID NO: 814252 - protein, 101 aa, Homo sapiens
TLRFIVVHCVVLHLIVVHCVVVHCVVVHCVVLHCVVPRMLITILGTVKPNANRIALDFQRGNDVAFHFNPRFNENNRRVIVCNTKLDNNWGRERKTVGFPI

SEQ ID NO: 814253 - protein, 161 aa, Homo sapiens
TKYSAALGIPSDSCCRKMADNFSLHDALSGSGNPNPQGWPGAWGNQPAGAGGYPGASYPGAYPGQAPPGAYPGQAPPGAYHGAPGAYPGAPAPGVYPGPPSGPGAYPSSGQPSAPGAYPATGPYGAPAGPLIVPYNLPLPGGVVPRMLITILGTVKPNANR

SEQ ID NO: 814254 - protein, 106 aa, Homo sapiens [sequence omitted]

SEQ ID NO: 814255 - protein, 396 aa, Homo sapiens
MSWSFLTRLLEEIHNHSTFVGKIWLTVLIVFRIVLTAVGGESIYYDEQSKFVCNTEQPGCENVCYDAFAPLSHVRFWVFQIILVATPSVMYLGYAIHKIAKMEHGEADKKAARSKPYAMRWKQHRALEETEEDNEEDPMMYPEMELESDKENKEQSQPKPKHDGRRRIREDGLMKIYVLQLLARTVFEVGFLIGQYFLYGFQVHPFYVCSRLPCPHKIDCFISRPTEKTIFLLIMYGVTGLCLLLNIWEMLHLGFGTIRDSLNSKRRELEDPGAYNYPFTWNTPSAPPGYNIAVKPDQIQYTELSNAKIAYKQNKANTAQEQQYGSHEENLPADLEALQREIRMAQERLDLAVQAYSHQNNPHGPREKKAKVGSKAGSNKSTASSKSGDGKTSVWI

SEQ ID NO: 814256 - protein, 396 aa, Homo sapiens; identical to SEQ ID NO: 814255

SEQ ID NO: 814257 - protein, 396 aa, Homo sapiens; identical to SEQ ID NO: 814255

SEQ ID NO: 814258 - protein, 138 aa, Homo sapiens
MSWSFLTRLLEEIHNHSTFVGKIWLTVLIVFRIVLTAVGGESIYYDEQSKFVCNTEQPGCENVCYDAFAPLSHVRFWVFQIILVATPSVMYLGYAIHKIAKMEHGEADKKAARSKPYAMRWKQHRALEATQEAEMRIT

SEQ ID NO: 814259 - protein, 138 aa, Homo sapiens; identical to SEQ ID NO: 814258

SEQ ID NO: 814260 - protein, 734 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQKYPEHAIHKVLQLMLRRGEIQHRMQRKVLYRLK

SEQ ID NO: 814261 - protein, 734 aa, Homo sapiens; identical to SEQ ID NO: 814260

SEQ ID NO: 814262 - protein, 734 aa, Homo sapiens; identical to SEQ ID NO: 814260

SEQ ID NO: 814263 - protein, 734 aa, Homo sapiens; identical to SEQ ID NO: 814260

SEQ ID NO: 814264 - protein, 756 aa, Homo sapiens
GEEVPGAAPSLFWPFVPTPGAVMSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQKYPEHAIHKVLQLMLRRGEIQHRMQRKVLYRLK

SEQ ID NO: 814265 - protein, 766 aa, Homo sapiens
MSGFDDPGIFYSDSFGGDAQADEGQARKSQLQRRFKEFLRQYRVGTDRTGFTFKYSLAPSLIEHLLPARYCSGCWAAALKLDLAPASRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQKYPEHAIHKVLQLMLRRGEIQHRMQRKVLYRLK

SEQ ID NO: 814266 - protein, 678 aa, Homo sapiens
MSGFDDPGIFYSDSFGGDAQADEGQARKSQYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQKYPEHAIHKVLQLMLRRGEIQHRMQRKVLYRLK

SEQ ID NO: 814267 - protein, 715 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQGALLPETPCLLLVV

SEQ ID NO: 814268 - protein, 638 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEAPRTSQAPSFLPQRKEL

SEQ ID NO: 814269 - protein, 692 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLCSDTWEPMAKRRLSCFSMRL

SEQ ID NO: 814270 - protein, 518 aa, Homo sapiens
MLQWTLRVLGMGGIRDLLSKSESQLFSFLLYPPLRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQKYPEHAIHKVLQLMLRRGEIQHRMQRKVLYRLK

SEQ ID NO: 814271 - protein, 466 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKSPDGLNPRGDINLLMLGDLGTASPASELWRGSPLGFRLGKARRVTALCDGTSARFSWGGPAASGACLLANARVLVPGPFPGTPPSGPPRTGLPPFTGFPLAVR

SEQ ID NO: 814272 - protein, 251 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTIRLGPKCHWADSSGRTCIAVASDLTEECWCAPGGIRTCAFDAVEGRGGTGPP

SEQ ID NO: 814273 - protein, 120 aa, Homo sapiens
SPLAGVSWSGKGQSHESELSGSLRRVLLAPAMCSHRNTRSTPSTRCCSSCCGAARSSIACSARFSTASSESRRLTGLMDSPTPRPSCRCLPLTMLLGPLPPHCSPRTSQAPSFLPQRKEL

SEQ ID NO: 814274 - protein, 203 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRPGPHIRTGPLSALAMVRRPTQKTKMWPRDAIVHIRT

SEQ ID NO: 814275 - protein, 107 aa, Homo sapiens
TTTTTNFAAASTLSVLYHESWLWAPVMCWDRYPNQTLKPSLYWWYLLELGFYLSLLIRLPFDVKRKDFKEQVIHHFVAVILMTFSYSANLLRIGSLVLLRFRRRGRE

SEQ ID NO: 814276 - protein, 394 aa, Homo sapiens [sequence omitted]

SEQ ID NO: 814277 - protein, 394 aa, Homo sapiens [sequence omitted]

SEQ ID NO: 814278 - protein, 394 aa, Homo sapiens [sequence omitted]

SEQ ID NO: 814279 - protein, 394 aa, Homo sapiens [sequence omitted]

SEQ ID NO: 814280 - protein, 394 aa, Homo sapiens [sequence omitted]

SEQ ID NO: 814281 - protein, 442 aa, Homo sapiens
MDVLAAASRICSVTQAGVQWCDHSSLQPQTPGLNQSSHLSLLSSRDYRMLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEACKMVNYMQYQQVCDALFLIFSFVFFYTRLVLFPTQILYTTYYESISNRGPFFGYYFFNGLLMLLQLLHVFWSCLILRMLYSFMKKGQMEKDIRSDVEESDSSEEAAAAQEPLQLKNGTAGGPRPAPTDGPRSRVAGRLTNRHTTAT

SEQ ID NO: 814282 - protein, 463 aa, Homo sapiens
LPPLKPFFPCWGPRPGQEQSPAAWGGRRVSAAAPGSPLGAPSPAPPPALGAPGRLHPQTSQLTGTCVHRMLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEACKMVNYMQYQQVCDALFLIFSFVFFYTRLVLFPTQILYTTYYESISNRGPFFGYYFFNGLLMLLQLLHVFWSCLILRMLYSFMKKGQMEKDIRSDVEESDSSEEAAAAQEPLQLKNGTAGGPRPAPTDGPRSRVAGRLTNRHTTAT

SEQ ID NO: 814283 - protein, 343 aa, Homo sapiens [sequence omitted]

SEQ ID NO: 814284 - protein, 230 aa, Homo sapiens [sequence omitted]

SEQ ID NO: 814285 - protein, 407 aa, Homo sapiens
MRLEGAARHLEEECSGQKAQQVQKALRLEQAWICSVTQAGVQWCDHSSLQPQTPGLNQSSHLSLLSSRDYRFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEACKMVNYMQYQQVCDALFLIFSFVFFYTRLVLFPTQILYTTYYESISNRGPFFGYYFFNGLLMLLQLLHVFWSCLILRMLYSFMKKGQMEKDIRSDVEESDSSEEAAAAQEPLQLKNGTAGGPRPAPTDGPRSRVAGRLTNRHTTAT

SEQ ID NO: 814286 - protein, 380 aa, Homo sapiens
AVLSEPVTLPLRDLVIPPAACLPPHTGSPISSPGLIGSVSFAPRFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEACKMVNYMQYQQVCDALFLIFSFVFFYTRLVLFPTQILYTTYYESISNRGPFFGYYFFNGLLMLLQLLHVFWSCLILRMLYSFMKKGQMEKDIRSDVEESDSSEEAAAAQEPLQLKNGTAGGPRPAPTDGPRSRVAGRLTNRHTTAT

SEQ ID NO: 814287 - protein, 285 aa, Homo sapiens
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEACKMVNYMQYQQVCDALFLIFSFVFFYTRLVLFPTHRT

SEQ ID NO: 814288 - protein, 144 aa, Homo sapiens [sequence omitted]

SEQ ID NO: 814289 - protein, 223 aa, Homo sapiens
RRGCGGSWAPGQCPRQQARRSSREGAVLGNILSNWLGLHSENEAPPLPASVGDKAPPLSGYLGDEAPPLFYSLGDEAPPLLNSGRWSPAPCVFLGDEAPPPAFLTGSPSPMRILYTTYYESISNRGPFFGYYFFNGLLMLLQLLHVFWSCLILRMLYSFMKKGQMEKDIRSDVEESDSSEEAAAAQEPLQLKNGTAGGPRPAPTDGPRSRVAGRLTNRHTTAT

SEQ ID NO: 814290 - protein, 151 aa, Homo sapiens
AEALLTSHPGSHLPQPPACPTRRLWLSSFSTPFAWLFPTQILYTTYYESISNRGPFFGYYFFNGLLMLLQLLHVFWSCLILRMLYSFMKKGQMEKDIRSDVEESDSSEEAAAAQEPLQLKNGTAGGPRPAPTDGPRSRVAGRLTNRHTTAT

SEQ ID NO: 814291 - protein, 183 aa, Homo sapiens
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASLTFSFYMSSFVGRPLGSGTTSHGCGHQLMCWAHGYQTKLWMPSFTR

SEQ ID NO: 814292 - protein, 104 aa, Homo sapiens
MSVPEEEERLLPLTQRWPRASKFLLSGCAATVAELGTRLPTPGPPGPVARAALGEGARAASRPAVRIGEVAPSMPAWQRWRWRPGPRWEEEGLRSPRPFPSNLF

SEQ ID NO: 814293 - protein, 323 aa, Homo sapiens
MSVPEEEERLLPLTQRWPRASKFLLSGCAATVAELATFPLDLTKTRLQMQGEAALARLGDGARESAPYRGMVRTALGIIEEEGFLKLWQGVTPAIYRHVVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRMTPWSMVFWLTYEKIREMSGVSPF

SEQ ID NO: 814294 - protein, 323 aa, Homo sapiens; identical to SEQ ID NO: 814293

SEQ ID NO: 814295 - protein, 826 aa, Homo sapiens
RVEATLSERKIGDSCDKDLPLKFCEFPQKTIMPGFKTTVYVSHINDLSDFYVQLIEDEAEISHLSERLNSVKTRPEYYVGPPLQRGDMICAVFPEDNLWYRAVIKEQQPNDLLSVQFIDYGNVSVVHTNKIGRLDLVNAILPGLCIHCSLQGFEVPDNKNSKKMMHYFSQRTSEAAIRCEFVKFQDRWEVILADEHGIIADDMISRYALSEKSQVELSTQVIKSASSKSVNKSDIDTSVFLNWYNPEKKMIRAYATVIDGPEYFWCQFADTEKLQCLEVEVQTAGEQVADRRNCIPCPYIGDPCIVRYREDGHYYRALITNICEDYLVSVRLVDFGNIEDCVDPKALWAIPSELLSVPMQAFPCCLSGFNISEGLCSQEGNDYFYEIITEDVLEITILEIRRDVCDIPLAIVDLKSKGKSINEKMEKYSKTGIKSALPYENIDSEIKQTLGSYNLDVGLKKLSNKAVQNKIYMEQQTDELAEITEKDVNIIGTKPSNFRDPKTDNICEGFENPCKDKIDTEELEGELECHLVDKAEFDDKYLITGFNTLLPHANETKEILELNSLEVPLSPDDESKEFLELESIELQNSLVVDEEKGELSPVPPNVPLSQECVTKGAMELFTLQLPLSCEAEKQPELELPTAQLPLDDKMDPLSLGVSQKAQESMCTEDMRKSSCVESFDDQRRMSLHLHGADCDPKTQNEMNICEEEFVEYKNRDAISALMPLFSEEESSDGSKHNNGLPDHISAQLQNTYTLKAFTVGSKCVVWSSLRNTWSKCEILETAEEGTRVLNLSNGMEEIVNPENVWNGIPKLDKSPPEKRGLEVMEI

SEQ ID NO: 814296 - protein, 826 aa, Homo sapiens; identical to SEQ ID NO: 814295

SEQ ID NO: 814297 - protein, 323 aa, Homo sapiens; identical to SEQ ID NO: 814293

SEQ ID NO: 814298 - protein, 304 aa, Homo sapiens
MSVPEEEERLLPLTQRWPRASKFLLSGCAATVAELATFPLDLTKTRLQMQGEAALARLGDGARESAPYRGMVRTALGIIEEEGFLKLWQGVTPAIYRHVVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRMNRLL

SEQ ID NO: 814299 - protein, 300 aa, Homo sapiens
MSVPEEEERLLPLTQRWPRASKFLLSGCAATVAELATFPLDLTKTRLQMQGEAALARLGDGARESAPYRGMVRTALGIIEEEGFLKLWQGVTPAIYRHVVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRM

SEQ ID NO: 814300 - protein, 310 aa, Homo sapiens
MSVPEEEERLLPLTQRWPRASKFLLSGCAATVAELATFPLDLTKTRLQMQGEAALARLGDGARESAPYRGMVRTALGIIEEEGFLKLWQGVTPAIYRHVVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRMEDTYSTETDL

SEQ ID NO: 814301 - protein, 300 aa, Homo sapiens; identical to SEQ ID NO: 814299

SEQ ID NO: 814302 - protein, 234 aa, Homo sapiens
MSECPLILYIHKHIDTYSQSYLFNDLFYPVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRMNRLL

SEQ ID NO: 814303 - protein, 234 aa, Homo sapiens; identical to SEQ ID NO: 814302

SEQ ID NO: 814304 - protein, 300 aa, Homo sapiens; identical to SEQ ID NO: 814299

SEQ ID NO: 814305 - protein, 103 aa, Homo sapiens
MSECPLILYIHKHIDTYSQSYLFNDLFYPVYSGGRMVTYEHLREVVFGKSEDEHYPLWKSVIGGMMAGVIGQFLANPTDLVKVQMQMEGKRKLEGKPLRFNHL

SEQ ID NO: 814306 - protein, 234 aa, Homo sapiens; identical to SEQ ID NO: 814302

SEQ ID NO: 814307 - protein, 1522 aa, Homo sapiens
MKAVRNLLIYIFSTYLLVMFGFNAAQDFWCSTLVKGVIYGSYSVSEMFPKNFTNCTWTLENPDPTKYSIYLKFSKKDLSCSNFSLLAYQFDHFSHEKIKDLLRKNHSIMQLCNSKNAFVFLQYDKNFIQIRRVFPTNFPGLQKKGEEDQKSFFEFLVLNKVSPSQFGCHVLCTWLESCLKSENGRTESCGIMYTKCTCPQHLGEWGIDDQSLILLNNVVLPLNEQTEGCLTQELQTTQVCNLTREAKRPPKEEFGMMGDHTIKSQRPRSVHEKRVPQEQADAAKFMAQTGESGVEEWSQWSTCSVTCGQGSQVRTRTCVSPYGTHCSGPLRESRVCNNTALCPVHGVWEEWSPWSLCSFTCGRGQRTRTRSCTPPQYGGRPCEGPETHHKPCNIALCPVDGQWQEWSSWSQCSVTCSNGTQQRSRQCTAAAHGGSECRGPWAESRECYNPECTANGQWNQWGHWSGCSKSCDGGWERRIRTCQGAVITGQQCEGTGEEVRRCSEQRCPAPYEICPEDYLMSMVWKRTPAGDLAFNQCPLNATGTTSRRCSLSLHGVAFWEQPSFARCISNEYRHLQHSIKEHLAKGQRMLAGDGMSQVTKTLLDLTQRKNFYAGDLLMSVEILRNVTDTFKRASYIPASDGVQNFFQIVSNLLDEENKEKWEDAQQIYPGSIELMQVIEDFIHIVGMGMMDFQNSYLMTGNVVASIQKLPAASVLTDINFPMKGRKGMVDWARNSEDRVVIPKSIFTPVSSKELDESSVFVLGAVLYKNLDLILPTLRNYTVINSKIIVVTIRPEPKTTDSFLEIELAHLANGTLNPYCVLWDDSKTNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGLPALVVATSVGFTRTKGYGTDHYCWLSLEGGLLYAFVGPAAAVVLVNMVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVQDAFRCRLRNCQDPINADSSSSFPNGHAQIMTDFEKDVDIACRSVLHKDIGPCRAATITGTLSRISLNDDEEEKGTNPEGLSYSTLPGNVISKVIIQQPTGLHMPMSMNELSNPCLKKENSELRRTVYLCTDDNLRGADMDIVHPQERMMESDYIVMPRSSVNNQPSMKEESKMNIGMETLPHERLLHYKVNPEFNMNPPVMDQFNMNLEQHLAPQEHMQNLPFEPRTAVKNFMASELDDNAGLSRSETGSTISMSSLERRKSRYSDLDFEKVMHTRKRHMELFQELNQKFQTLDRFRDIPNTSSMENPAPNKNPWDTFKNPSEYPHYTTINVLDTEAKDALELRPAEWEKCLNLPLDVQEGDFQTEV

SEQ ID NO: 814308 - protein, 984 aa, Homo sapiens
MKAVRNLLIYIFSTYLLVMFGFNAAQDFWCSTLVKGVIYGSYSVSEMFPKNFTNCTWTLENPDPTKYSIYLKFSKKDLSCSNFSLLAYQFDHFSHEKIKDLLRKNHSIMQLCNSKNAFVFLQYDKNFIQIRRVFPTNFPGLQKKGEEDQKSFFEFLVLNKVSPSQFGCHVLCTWLESCLKSENGRTESCGIMYTKCTCPQHLGEWGIDDQSLILLNNVVLPLNEQTEGCLTQELQTTQVCNLTREAKRPPKEEFGMMGDHTIKSQRPRSVHEKRVPQEQADAAKFMAQTGESGVEEWSQWSTCSVTCGQGSQVRTRTCVSPYGTHCSGPLRESRVCNNTALCPVHGVWEEWSPWSLCSFTCGRGQRTRTRSCTPPQYGGRPCEGPETHHKPCNIALCPVDGQWQEWSSWSQCSVTCSNGTQQRSRQCTAAAHGGSECRGPWAESRECYNPECTANGQWNQWGHWSGCSKSCDGGWERRIRTCQGAVITGQQCEGTGEEVRRCSEQRCPAPYEICPEDYLMSMVWKRTPAGDLAFNQCPLNATGTTSRRCSLSLHGVAFWEQPSFARCISNEYRHLQHSIKEHLAKGQRMLAGDGMSQVTKTLLDLTQRKNFYAGDLLMSVEILRNVTDTFKRASYIPASDGVQIYPGSIELMQVIEDFIHIVGMGMMDFQNSYLMTGNVVASIQKLPAASVLTDINFPMKGRKGMVDWARNSEDRVVIPKSIFTPVSSKELDESSVFVLGAVLYKNLDLILPTLRNYTVINSKIIVVTIRPEPKTTDSFLEIELAHLANGTLNPYCVLWDDSKTNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGKHIDIPFHALLKMTLNTH

SEQ ID NO: 814309 - protein, 713 aa, Homo sapiens
QGRQRRAGLSEVWSRKLRNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGLPALVVATSVGFTRTKGYGTDHYCWLSLEGGLLYAFVGPAAAVVLVNMVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVQDAFRCRLRNCQDPINADSSSSFPNGHAQIMTDFEKDVDIACRSVLHKDIGPCRAATITGTLSRISLNDDEEEKGTNPEGLSYSTLPGNVISKVIIQQPTGLHMPMSMNELSNPCLKKENSELRRTVYLCTDDNLRGADMDIVHPQERMMESDYIVMPRSSVNNQPSMKEESKMNIGMETLPHERLLHYKVNPEFNMNPPVMDQFNMNLEQHLAPQEHMQNLPFEPRTAVKNFMASELDDNAGLSRSETGSTISMSSLERRKSRYSDLDFEKVMHTRKRHMELFQELNQKFQTLDRFRDIPNTSSMENPAPNKNPWDTFKNPSEYPHYTTINVLDTEAKDALELRPAEWEKCLNLPLDVQEGDFQTEV

SEQ ID NO: 814310 - protein, 652 aa, Homo sapiens [sequence omitted]

SEQ ID NO: 814311 - protein, 886 aa, Homo sapiens
MKAVRNLLIYIFSTYLLVMFGFNAAQDFWCSTLVKGVIYGSYSVSEMFPKNFTNCTWTLENPDPTKYSIYLKFSKKDLSCSNFSLLAYQFDHFSHEKIKDLLRKNHSIMQLCNSKNAFVFLQYDKNFIQIRRVFPTNFPGLQKKGEEDQKSFFEFLVLNKVSPSQFGCHVLCTWLESCLKSENGRTESCGIMYTKCTCPQHLGEWGIDDQSLILLNNVVLPLNEQTEGCLTQELQTTQVCNLTREAKRPPKEEFGMMGDHTIKSQRPRSVHEKRVPQEQADAAKFMAQTGESGVEEWSQWSTCSVTCGQGSQVRTRTCVSPYGTHCSGPLRESRVCNNTALCPVHGVWEEWSPWSLCSFTCGRGQRTRTRSCTPPQYGGRPCEGPETHHKPCNIALCPVDGQWQEWSSWSQCSVTCSNGTQQRSRQCTAAAHGGSECRGPWAESRECYNPECTANGQWNQWGHWSGCSKSCDGGWERRIRTCQGAVITGQQCEGTGEEVRRCSEQRCPAPYEICPEDYLMSMVWKRTPAGDLAFNQCPLNATGTTSRRCSLSLHGVAFWEQPSFARCISNEYRHLQHSIKEHLAKGQRMLAGDGMSQVTKTLLDLTQRKNFYAGDLLMSVEILRNVTDTFKRASYIPASDGVQNFFQIVSNLLDEENKEKWEDAQQIYPGSIELMQVIEDFIHIVGMGMMDFQNSYLMTGNVVASIQKLPAASVLTDINFPMKGRKGMVDWARNSEDRVVIPKSIFTPVSSKELDESSVFVLGAVLYKNLDLILPTLRNYTVINSKIIVVTIRPEPKTTDSFLEIELAHLANGTLNPYCVLWDDSKTNESLGTWSTQGCKTVLTDASHTKCLCDRLSTFAILAQQPREICLNLPLDVQEGDFQTEV

SEQ ID NO: 814312 - protein, 368 aa, Homo sapiens
QGRQRRAGLSEVWSRKLRNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGLPALVVATSVGFTRTKGYGTDHYCWLSLEGGLLYAFVGPAAAVVLVNMVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVRSILVIENSDGWNGISLLKRMIF

SEQ ID NO: 814313 - protein, 705 aa, Homo sapiens
MKAVRNLLIYIFSTYLLVMFGFNAAQDFWCSTLVKGVIYGSYSVSEMFPKNFTNCTWTLENPDPTKYSIYLKFSKKDLSCSNFSLLAYQFDHFSHEKIKDLLRKNHSIMQLCNSKNAFVFLQYDKNFIQIRRVFPTNFPGLQKKGEEDQKSFFEFLVLNKVSPSQFGCHVLCTWLESCLKSENGRTESCGIMYTKCTCPQHLGEWGIDDQSLILLNNVVLPLNEQTEGCLTQELQTTQVCNLTREAKRPPKEEFGMMGDHTIKSQRPRSVHEKRVPQEQADAAKFMAQTGESGVEEWSQWSTCSVTCGQGSQVRTRTCVSPYGTHCSGPLRESRVCNNTALCPVHGVWEEWSPWSLCSFTCGRGQRTRTRSCTPPQYGGRPCEGPETHHKPCNIALCPVDGQWQEWSSWSQCSVTCSNGTQQRSRQCTAAAHGGSECRGPWAESRECYNPECTANGQWNQWGHWSGCSKSCDGGWERRIRTCQGAVITGQQCEGTGEEVRRCSEQRCPAPYEICPEDYLMSMVWKRTPAGDLAFNQCPLNATGTTSRRCSLSLHGVAFWEQPSFARCISNEYRHLQHSIKEHLAKGQRMLAGDGMSQVTKTLLDLTQRKNFYAGDLLMSVEILRNVTDTFKRASYIPASDGVQNFFQIVSNLLDEENKEKWEDAQQIYPGSIELMQVIEDFIHIVGMGMMDFQNSYLMTGNVGKK

SEQ ID NO: 814314 - protein, 128 aa, Homo sapiens
GDFLSVTPLFLAPCASLAIAYKRTAGCDGRRPSQHQGGDGNVPGRRTESWTPRGKPRAPGDSRNDGAWISVPGCLPEEAEVGTKSCWLCFSQTSLEYDCHPTQENATQGQMQWRRLAWKSSMYWRWKS

SEQ ID NO: 814315 - protein, 183 aa, Homo sapiens
MAGGPPNTKAEMEMSLAEELNHGRQGENQEHLVIAEMMELGSRSRGASQKKQKLEQKAAGSASAKRVWNMTATRPKKMGSQLPKPRMLRESGHGDAHLQEYAGNFQGIRFHYDRNPGTDAVAQTSLEEFNVLEMEVMRRQLYAVNRRLRALEEQGATWRHRETLIIAVLVSASIANLWLWMNQ

SEQ ID NO: 814316 - protein, 148 aa, Homo sapiens
GDFLSVTPLFLAPCASLAIAYKRTAGCDGRRPSQHQGGDGNVPGRRTESWTPRGKPRAPGDSRNDGAWISVPGCLPEEAEVGTKSCWLCFSQTSLEYDCHPTQENGMPISRSTLAISKAYVSIMIATQGQMQWRRLAWKSSMYWRWKS

SEQ ID NO: 814317 - protein, 182 aa, Homo sapiens
AGPVRSRGWRAAGSAGPQEMTAGGQAEAEGAGGEPGAARLPSRVARLLSALFYGTCSFLIVLVNKALLTTYGFPSPIFLGIGQMAATIMILYVSKLNKIIHFPDFDKKIPVKLFPLPLLYVGNHISGLSSTSKLSLPMFTVLRKFTIPLTLLLETIILGKQYSLNIILSVFAIILGAFIAAG

SEQ ID NO: 814318 - protein, 84 aa, Homo sapiens
AGPVRSRGWRAAGSAGPQEMTAGGQAEAEGAGGEPGAARLPSRVARLLSALFYGTCSFLIVLVNKALLTTYGFKHTENGKAKEE

SEQ ID NO: 814319 - protein, 356 aa, Homo sapiens
AGPVRSRGWRAAGSAGPQEMTAGGQAEAEGAGGEPGAARLPSRVARLLSALFYGTCSFLIVLVNKALLTTYGFPSPIFLGIGQMAATIMILYVSKLNKIIHFPDFDKKIPVKLFPLPLLYVGNHISGLSSTSKLSLPMFTVLRKFTIPLTLLLETIILGKQYSLNIILSVFAIILGAFIAAGSDLAFNLEGYIFVFLNDIFTAANGVYTKQKMDPKELGKYGVLFYNACFMIIPTLIISVSTGDLQQATEFNQWKNVVFILQFLLSCFLGFLLMYSTVLCSYYNSALTTAVVGAIKNVSVAYIGILIGGDYIFSLLNFVGLNICMAGGLRYSFLTLSSQLKPKPVGEENICLDLKS

SEQ ID NO: 814320 - protein, 356 aa, Homo sapiens; identical to SEQ ID NO: 814319

SEQ ID NO: 814321 - protein, 314 aa, Homo sapiens
AGPVRSRGWRAAGSAGPQEMTAGGQAEAEGAGGEPGAARLPSRVARLLSALFYGTCSFLIVLVNKALLTTYGFPSPIFLGIGQMAATIMILYVSKLNKIIHFPDFDKKIPVKLFPLPLLYVGNHISGLSSTSKLSLPMFTVLRKFTIPLTLLLETIILGKQYSLNIILSVFAIILGAFIAAGSDLAFNLEGYIFVFLNDIFTAANGVYTKQKMDPKELGKYGVLFYNACFMIIPTLIISVSTGDLQQATEFNQWKNVVFILQFLLSCFLGFLLMYSTVLCSYYNSALTTAVVGAIKHGRGLEIFLFNTEQPVKT

SEQ ID NO: 814322 - protein, 104 aa, Homo sapiens [sequence omitted]

SEQ ID NO: 814323 - protein, 78 aa, Homo sapiens
SAGSPAASCSPAQERSGEAAVGAGRRPALRELGEERGGDGGGGSRRGGGGSPFLFSDPGASGTRSPELGRRGDCGGLG

SEQ ID NO: 814324 - protein, 78 aa, Homo sapiens; identical to SEQ ID NO: 814323

SEQ ID NO: 814325 - protein, 545 aa, Homo sapiens
MSRKQNQKDSSGFIFDLQSNTVLAQGGAFENMKEKINAVRAIVPNKSNNEIILVLQHFDNCVDKTVQAFMEGSASEVLKEWTVTGKKKNKKKKNKPKPAAEPSNGIPDSSKSVSIQEEQSAPSSEKGGMNGYHVNGAINDTESVDSLSEGLETLSIDARELEDPESAMLDTLDRTGSMLQNGVSDFETKSLTMHSIHNSQQPRNAAKSLSRPTTETQFSNMGMEDVPLATSKKLSSNIEKSVKDLQRCTVSLARYRVVVKEEMDASIKKMKQAFAELESCLMDREVALLAEMDKVKAEAMEILLSRQKKAELLKKMTHVAVQMSEQQLVELRADIKHFVSERKYDEDLGRVARFTCDVETLKKSIDSFGQVSHPKNSYSTRSRCSSVTSVSLSSPSDASAASSSTCASPPSLTSANKKNFAPGETPAAIANSSGQPYQPLREVLPGNRRGGQGYRPQGQKSNDPMNQGRHDSMGRYRNSSWYSSGSRYQSAPSQAPGNTIERGQTHSAGTNGTGVSMEPSPPTPSFKKGLPQRKPRTSQTEAVNS

SEQ ID NO: 814326 - protein, 545 aa, Homo sapiens; identical to SEQ ID NO: 814325

SEQ ID NO: 814327 - protein, 545 aa, Homo sapiens; identical to SEQ ID NO: 814325

SEQ ID NO: 814328 - protein, 545 aa, Homo sapiens; identical to SEQ ID NO: 814325

SEQ ID NO: 814329 - protein, 527 aa, Homo sapiens
MSRKQNQKDSSGFIFDLQSNTVLAQGGAFENMKEKINAVRAIVPNKSNNEIILVLQHFDNCVDKTVQAFMEGSASEVLKEWTVTGKKKNKKKKNKPKPAAEPSNGIPDSSKSVSIQEEQSAPSSEKGGMNGYHVNGAINDTESVDSLSEGLETLSIDARELEDPESAMLDTLDRTGSMLQNGVSDFETKSLTMHSIHNSQQPRNAAKSLSRPTTETQFSNMGMEDVPLATSKKLSSNIEKSVKDLQRCTVSLARYRVVVKEEMDASIKKMKQAFAELESCLMDREVALLAEMDKVKAEAMEILLSRQQQLVELRADIKHFVSERKYDEDLGRVARFTCDVETLKKSIDSFGQVSHPKNSYSTRSRCSSVTSVSLSSPSDASAASSSTCASPPSLTSANKKNFAPGETPAAIANSSGQPYQPLREVLPGNRRGGQGYRPQGQKSNDPMNQGRHDSMGRYRNSSWYSSGSRYQSAPSQAPGNTIERGQTHSAGTNGTGVSMEPSPPTPSFKKGLPQRKPRTSQTEAVNS

SEQ ID NO: 814330 - protein, 560 aa, Homo sapiens
MSRKQNQKDSSGFIFDLQSNTVLAQGGAFENMKEKINAVRAIVPNKSNNEIILVLQHFDNCVDKTVQAFMEGSASEVLKEWTVTGKKKNKKKKNKPKPAAEPSNGIPDSSKSVSIQEEQSAPSSEKGGMNGYHVNGAINDTESVDSLSEGLETLSIDARELEDPESAMLDTLDRTGSMLQNGVSDFETKSLTMHSIHNSQQPRNAAKSLSRPTTETQFSNMGMEDVPLATSKKLSSNIEKSVKDLQRCTVSLARYRVVVKEEMDASIKKMKQAFAELESWYSNAARVLGAKYLPSLMDREVALLAEMDKVKAEAMEILLSRQKKAELLKKMTHVAVQMSEQQLVELRADIKHFVSERKYDEDLGRVARFTCDVETLKKSIDSFGQVSHPKNSYSTRSRCSSVTSVSLSSPSDASAASSSTCASPPSLTSANKKNFAPGETPAAIANSSGQPYQPLREVLPGNRRGGQGYRPQGQKSNDPMNQGRHDSMGRYRNSSWYSSGSRYQSAPSQAPGNTIERGQTHSAGTNGTGVSMEPSPPTPSFKKGLPQRKPRTSQTEAVNS

SEQ ID NO: 814331 - protein, 455 aa, Homo sapiens
MSRKQNQKDSSGFIFDLQSNTVLAQGGAFENMKEKINAVRAIVPNKSNNEIILVLQHFDNCVDKTVQAFMEGSASEVLKEWTVTGKKKNKKKKNKPKPAAEPSNGIPDSSKSVSIQEEQSAPSSEKGGMNGYHVNGAINDTESVDSLSEGLETLSIDARELEDPESAMLDTLDRTGSMLQNGVSDFETKSLTMHSIHNSQQPRNAAKSLSRPTTETQFSNMGMEDVPLATSKKLSSNIEKSVKDLQRCTVSLARYRVVVKEEMDASIKKMKQAFAELESCLMDREVALLAEMDKVKAEAMEILLSRQKKAELLKKMTHVAVQMSEQQLVELRADIKHFVSERKYDEDLGRVARFTCDVETLKKSIDSFGQVSHPKNSYSTRSRCSSVTSVSLSSPSDASAASSSTCASPPSLTSANKKNFAPGETPAAIANSSGQPYQPLREVSECSISGTRKHH

SEQ ID NO: 814332 - protein, 264 aa, Homo sapiens [sequence omitted]

SEQ ID NO: 814333 - protein, 281 aa, Homo sapiens
MSRKQNQKDSSGFIFDLQSNTVLAQGGAFENMKEKINAVRAIVPNKSNNEIILVLQHFDNCVDKTVQAFMEGSASEVLKEWTVTGKKKNKKKKNKPKPAAEPSNGIPDSSKSVSIQEEQSAPSSEKGGMNGYHVNGAINDTESVDSLSEGLETLSIDARELEDPESAMLDTLDRTGSMLQNGVSDFETKSLTMHSIHNSQQPRNAAKSLSRPTTETQFSNMGMEDVPLATSKKLSSNIEKSVKDLQRCTVSLARYRVVVKEEMDASIKKMKQAFAELESCD

SEQ ID NO: 814334 - protein, 281 aa, Homo sapiens
MSRKQNQKDSSGFIFDLQSNTVLAQGGAFENMKEKINAVRAIVPNKSNNEIILVLQHFDNCVDKTVQAFMEGSASEVLKEWTVTGKKKNKKKKNKPKPAAEPSNGIPDSSKSVSIQEEQSAPSSEKGGMNGYHVNGAINDTESVDSLSEGLETLSIDARELEDPESAMLDTLDRTGSMLQNGVSDFETKSLTMHSIHNSQQPRNAAKSLSRPTTETQFSNMGMEDVPLATSKKLSSNIEKSVKDLQRCTVSLARYRVVVKEEMDASIKKMKQAFAELESCV

SEQ ID NO: 814335 - protein, 334 aa, Homo sapiens
MSRKQNQKDSSGFIFDLQSNTVLAQGGAFENMKEKINAVRAIVPNKSNNEIILVLQHFDNCVDKTVQAFMEGSASEVLKEWTVTGKKKNKKKKNKPKPAAEPSNGIPDSSKSVSIQEEQSAPSSEKGGMNGYHVNGAINDTESVDSLSEGLETLSIDARELEDPESAMLDTLDRTGSMLQNGVSDFETKSLTMHSIHNSQQPRNAAKSLSRPTTETQFSNMGMEDVPLATSKKLSSNIEKSVKDLQRCTVSLARYRVVVKEEMDASIKKMKQAFAELESWYSNAARVLGAKYCQGLGNAFLAKYCYPTIIVSSLQFDAFGLICQPNLFSYKSVY

SEQ ID NO: 814336 - protein, 181 aa, Homo sapiens
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 814337 - protein, 229 aa, Homo sapiens
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKLQYYRATGRLCGITRVSLKKRVCIFLNPVLLSHLPSSSRSLMSPGVSQESEKLESVNAELKAQIEELKNEKQHLIYMLNLHRPTCIVRAQNGRTPEDERNLFIQQIKEGTLQS

SEQ ID NO: 814338 - protein, 157 aa, Homo sapiens
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKSECLLALPFLSLTPVFTSFMWLSEEELENPLLGYSFPRRAL

SEQ ID NO: 814339 - protein, 157 aa, Homo sapiens; identical to SEQ ID NO: 814338

SEQ ID NO: 814340 - protein, 157 aa, Homo sapiens; identical to SEQ ID NO: 814338

SEQ ID NO: 814341 - protein, 181 aa, Homo sapiens; identical to SEQ ID NO: 814336

SEQ ID NO: 814342 - protein, 126 aa, Homo sapiens
VSKIPVRYYVPVLLSHLPSSSRSLMSPGVSQVHPCIQAAAQATPSSLALAPFLMPLLLVPQESEKLESVNAELKAQIEELKNEKQHLIYMLNLHRPTCIVRAQNGRTPEDERNLFIQQIKEGTLQS

SEQ ID NO: 814343 - protein, 124 aa, Homo sapiens
MSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 814344 - protein, 147 aa, Homo sapiens
YRLGSEAWVLLRFAIQNKHLCHRMSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 814345 - protein, 84 aa, Homo sapiens
RSADVQILKKEKTECLQNEESEKLESVNAELKAQIEELKNEKQHLIYMLNLHRPTCIVRAQNGRTPEDERNLFIQQIKEGTLQS

SEQ ID NO: 814346 - protein, 130 aa, Homo sapiens
FGRFSREAINSITSAWDWQHGVNDRAASLRAIKGVMQRSPSHSRTQPGAHCTALFSRRRPSAPFSPRAGRESSVLARRPDKQPARPRPDPGRPERSLEQNDASTPRPGLCLGSECFCHRPLPVPSWVTGV

SEQ ID NO: 814347 - protein, 181 aa, Homo sapiens; identical to SEQ ID NO: 814336

SEQ ID NO: 814348 - protein, 181 aa, Homo sapiens; identical to SEQ ID NO: 814336

SEQ ID NO: 814349 - protein, 181 aa, Homo sapiens; identical to SEQ ID NO: 814336

SEQ ID NO: 814350 - protein, 181 aa, Homo sapiens; identical to SEQ ID NO: 814336

SEQ ID NO: 814351 - protein, 181 aa, Homo sapiens; identical to SEQ ID NO: 814336

SEQ ID NO: 814352 - protein, 141 aa, Homo sapiens
IELLNSSITLKDDIPPIYPTSPGPIPITLAMEHVVLKRSDDGVFHIGAAAQDKPSAEVLKSEKRQPPKEQVFLVPTGEVFEQQVKELPILQKELIETKQALANANQDKENFFRRLGNITPSLSSETSGSAICAKERGYHQQ

SEQ ID NO: 814353 - protein, 141 aa, Homo sapiens; identical to SEQ ID NO: 814352

SEQ ID NO: 814354 - protein, 526 aa, Homo sapiens
MDVRFYPPPAQPAAAPDAPCLGPSPCLDPYYCNKFDGENMYMSMTEPSQDYVPASQSYPGPSLESEDFNIPPITPPSLPDHSLVHLNEVESGYHSLCHPMNHNGLLPFHPQNMDLPEITVSNMLGQDGTLLSNSISVMPDIRNPEGTQYSSHPQMAAMRPRGQPADIRQQPGMMPHGQLTTINQSQLSAQLGLNMGGSNVPHNSPSPPGSKSATPSPSSSVHEDEGDDTSKINGGEKRPASDMGKKPKTPKKKKKKDPNEPQKPVSAYALFFRDTQAAIKGQNPNATFGEVSKIVASMWDGLGEEQKQVYKKKTEAAKKEYLKQLAAYRASLVSKSYSEPVDVKTSQPPQLINSKPSVFHGPSQAHSALYLSSHYHQQPGMNPHLTAMHPSLPRNIAPKPNNQMPVTVSIANMAVSPPPPLQISPPLHQHLNMQQHQPLTMQQPLGNQLPMQVQSALHSPTMQQGFTLQPDYQTIINPTSTAAQVVTQAMEYVRSGCRNPPPQPVDWNNDYCSSGGMQRDKALYLT

SEQ ID NO: 814355 - protein, 227 aa, Homo sapiens
MDVRFYPPPAQPAAAPDAPCLGPSPCLDPYYCNKFDGENMYMSMTEPSQDYVPASQSYPGPSLESEDFNIPPITPPSLPDHSLVHLTAMHPSLPRNIAPKPNNQMPVTVSIANMAVSPPPPLQISPPLHQHLNMQQHQPLTMQQPLGNQLPMQVQSALHSPTMQQGFTLQPDYQTIINPTSTAAQVVTQAMEYVRSGCRNPPPQPVDWNNDYCSSGGMQRDKALYLT

SEQ ID NO: 814356 - protein, 526 aa, Homo sapiens; identical to SEQ ID NO: 814354

SEQ ID NO: 814357 - protein, 526 aa, Homo sapiens; identical to SEQ ID NO: 814354

SEQ ID NO: 814358 - protein, 216 aa, Homo sapiens
AGERPGAQGEGGCGAVCSMAYPGHPGAGGGYYPGGYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 814359 - protein, 216 aa, Homo sapiens; identical to SEQ ID NO: 814358

SEQ ID NO: 814360 - protein, 213 aa, Homo sapiens
AGERPGAQGEGGCGAVCSMAYPGHPGAGGGYYPGGYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDVSLRN

SEQ ID NO: 814361 - protein, 216 aa, Homo sapiens; identical to SEQ ID NO: 814358

SEQ ID NO: 814362 - protein, 203 aa, Homo sapiens
SARRQSSKDHQLLPIRLQLKMQYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 814363 - protein, 185 aa, Homo sapiens
PVSQYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 814364 - protein, 188 aa, Homo sapiens
AGERPGAQGEGGCGAVCSMAYPGHPGAGGGYYPGGDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 814365 - protein, 121 aa, Homo sapiens [sequence omitted]

SEQ ID NO: 814366 - protein, 155 aa, Homo sapiens
GLVLDLHADVLALMLDVVWHVGGSKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 814367 - protein, 137 aa, Homo sapiens
MACSEDTNFNRETCRLMVSRLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 814368 - protein, 109 aa, Homo sapiens
MGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 814369 - protein, 94 aa, Homo sapiens
DDSRVTPRGHFGSGTVDPQELQKALTTMGFRLSPQAVNSIAKRYSTNGKITFDDYIACCVKLRALTDSFRRRDTAQQGVVNFPYDDFIQCVMSV

SEQ ID NO: 814370 - protein, 214 aa, Homo sapiens
SGERPGAQGEGGCGAVCSMAYPGHPGAGGGYYPGGYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQVHSMCHECLNQEEAA

SEQ ID NO: 814371 - protein, 298 aa, Homo sapiens
SGERPGAQGEGGCGAVCSMAYPGHPGAGGGYYPGGYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTSGRAELGGPCGAPGVKMASSAEGDEGTVVALAGVLQSGFQELSLNGLATSLGASEQALRLIISIFLGYPFALVYRHYLFYKETYLIHLFHTFTGLSIAYFNF

SEQ ID NO: 814372 - protein, 1190 aa, Homo sapiens
LGRQSEAPAQSLGSGRRGCSAPLPARSWAPAPGPGPPAVDFKMSVPDYMQCAEDHQTLLVVVQPVGIVSEENFFRIYKRICSVSQISVRDSQRVLYIRYRHHYPPENNEWGDFQTHRKVVGLITITDCFSAKDWPQTFEKFHVQKEIYGSTLYDSRLFVFGLQGEIVEQPRTDVAFYPNYEDCQTVEKRIEDFIESLFIVLESKRLDRATDKSGDKIPLLCVPFEKKDFVGLDTDSRHYKKRCQGRMRKHVGDLCLQAGMLQDSLVHYHMSVELLRSVNDFLWLGAALEGLCSASVIYHYPGGTGGKSGARRFQGSTLPAEAANRHRPGAQEVLIDPGALTTNGINPDTSTEIGRAKNCLSPEDIIDKYKEAISYYSKYKNAGVIELEACIKAVRVLAIQKRSMEASEFLQNAVYINLRQLSEEEKIQRYSILSELYELIGFHRKSAFFKRVAAMQCVAPSIAEPGWRACYKLLLETLPGYSLSLDPKDFSRGTHRGWAAVQMRLLHELVYASRRMGNPALSVRHLSFLLQTMLDFLSDQEKKDVAQSLENYTSKCPGTMEPIALPGGLTLPPVPFTKLPIVRHVKLLNLPASLRPHKMKSLLGQNVSTKSPFIYSPIIAHNRGEERNKKIDFQWVQGDVCEVQLMVYNPMPFELRVENMGLLTSGVEFESLPAALSLPAESGLYPVTLVGVPQTTGTITVNGYHTTVFGVFSDCLLDNLPGIKTSGSTVEVIPALPRLQISTSLPRSAHSLQPSSGDEISTNVSVQLYNGESQQLIIKLENIGMEPLEKLEVTSKVLTTKEKLYGDFLSWKLEETLAQFPLQPGKVATFTINIKVKLDFSCQENLLQDLSDDGISVSGFPLSSPFRQVVRPRVEGKPVNPPESNKAGDYSHVKTLEAVLNFKYSGGPGHTEGYYRNLSLGLHVEVEPSVFFTRVSTLPATSTRQCHLLLDVFNSTEHELTVSTRSSEALILHAGECQRMAIQVDKFNFESFPESPGEKGQFANPKQLEEERREARGLEIHSKLGICWRIPSLKRSGEASVEGLLNQLVLEHLQLAPLQWDVLVDGQPCDREAVAACQVGDPVRLEVRLTNRSPRSVGPFALTVVPFQDHQNGVHNYDLHDTVSFVGSSTFYLDAVQPSGQSACLGALLFLYTGDFFLHIRFHEDSTSKELPPSWFCLPSVHVCALEAQA

SEQ ID NO: 814373 - protein, 1181 aa, Homo sapiens
LGRQSEAPAQSLGSGRRGCSAPLPARSWAPAPGPGPPAVDFKMSVPDYMQCAEDHQTLLVVVQPVGIVSEENFFRIYKRICSVSQISVRDSQRVLYIRYRHHYPPENNEWGDFQTHRKVVGLITITDCFSAKDWPQTFEKFHVQKEIYGSTLYDSRLFVFGLQGEIVEQPRTDVAFYPNYEDCQTVEKRIEDFIESLFIVLESKRLDRATDKSGDKIPLLCVPFEKKDFVGLDTDSRHYKKRCQGRMRKHVGDLCLQAGMLQDSLVHYHMSVELLRSVNDFLWLGAALEGLCSASVIYHYPGGTGGKSGARRFQGSTLPAEAANRHRPGALTTNGINPDTSTEIGRAKNCLSPEDIIDKYKEAISYYSKYKNAGVIELEACIKAVRVLAIQKRSMEASEFLQNAVYINLRQLSEEEKIQRYSILSELYELIGFHRKSAFFKRVAAMQCVAPSIAEPGWRACYKLLLETLPGYSLSLDPKDFSRGTHRGWAAVQMRLLHELVYASRRMGNPALSVRHLSFLLQTMLDFLSDQEKKDVAQSLENYTSKCPGTMEPIALPGGLTLPPVPFTKLPIVRHVKLLNLPASLRPHKMKSLLGQNVSTKSPFIYSPIIAHNRGEERNKKIDFQWVQGDVCEVQLMVYNPMPFELRVENMGLLTSGVEFESLPAALSLPAESGLYPVTLVGVPQTTGTITVNGYHTTVFGVFSDCLLDNLPGIKTSGSTVEVIPALPRLQISTSLPRSAHSLQPSSGDEISTNVSVQLYNGESQQLIIKLENIGMEPLEKLEVTSKVLTTKEKLYGDFLSWKLEETLAQFPLQPGKVATFTINIKVKLDFSCQENLLQDLSDDGISVSGFPLSSPFRQVVRPRVEGKPVNPPESNKAGDYSHVKTLEAVLNFKYSGGPGHTEGYYRNLSLGLHVEVEPSVFFTRVSTLPATSTRQCHLLLDVFNSTEHELTVSTRSSEALILHAGECQRMAIQVDKFNFESFPESPGEKGQFANPKQLEEERREARGLEIHSKLGICWRIPSLKRSGEASVEGLLNQLVLEHLQLAPLQWDVLVDGQPCDREAVAACQVGDPVRLEVRLTNRSPRSVGPFALTVVPFQDHQNGVHNYDLHDTVSFVGSSTFYLDAVQPSGQSACLGALLFLYTGDFFLHIRFHEDSTSKELPPSWFCLPSVHVCALEAQA

SEQ ID NO: 814374 - protein, 1177 aa, Homo sapiens
TGLVDPGLRRMMRGRPRMSAMSWAPAPGPWGHLDVDFKMSVPDYMQCAEDHQTLLVVVQPVGIVSEENFFRIYKRICSVSQISVRDSQRVLYIRYRHHYPPENNEWGDFQTHRKVVGLITITDCFSAKDWPQTFEKFHVQKEIYGSTLYDSRLFVFGLQGEIVEQPRTDVAFYPNYEDCQTVEKRIEDFIESLFIVLESKRLDRATDKSGDKIPLLCVPFEKKDFVGLDTDSRHYKKRCQGRMRKHVGDLCLQAGMLQDSLVHYHMSVELLRSVNDFLWLGAALEGLCSASVIYHYPGGTGGKSGARRFQGSTLPAEAANRHRPGALTTNGINPDTSTEIGRAKNCLSPEDIIDKYKEAISYYSKYKNAGVIELEACIKAVRVLAIQKRSMEASEFLQNAVYINLRQLSEEEKIQRYSILSELYELIGFHRKSAFFKRVAAMQCVAPSIAEPGWRACYKLLLETLPGYSLSLDPKDFSRGTHRGWAAVQMRLLHELVYASRRMGNPALSVRHLSFLLQTMLDFLSDQEKKDVAQSLENYTSKCPGTMEPIALPGGLTLPPVPFTKLPIVRHVKLLNLPASLRPHKMKSLLGQNVSTKSPFIYSPIIAHNRGEERNKKIDFQWVQGDVCEVQLMVYNPMPFELRVENMGLLTSGVEFESLPAALSLPAESGLYPVTLVGVPQTTGTITVNGYHTTVFGVFSDCLLDNLPGIKTSGSTVEVIPALPRLQISTSLPRSAHSLQPSSGDEISTNVSVQLYNGESQQLIIKLENIGMEPLEKLEVTSKVLTTKEKLYGDFLSWKLEETLAQFPLQPGKVATFTINIKVKLDFSCQENLLQDLSDDGISVSGFPLSSPFRQVVRPRVEGKPVNPPESNKAGDYSHVKTLEAVLNFKYSGGPGHTEGYYRNLSLGLHVEVEPSVFFTRVSTLPATSTRQCHLLLDVFNSTEHELTVSTRSSEALILHAGECQRMAIQVDKFNFESFPESPGEKGQFANPKQLEEERREARGLEIHSKLGICWRIPSLKRSGEASVEGLLNQLVLEHLQLAPLQWDVLVDGQPCDREAVAACQVGDPVRLEVRLTNRSPRSVGPFALTVVPFQDHQNGVHNYDLHDTVSFVGSSTFYLDAVQPSGQSACLGALLFLYTGDFFLHIRFHEDSTSKELPPSWFCLPSVHVCALEAQA

SEQ ID NO: 814375 - protein, 319 aa, Homo sapiens
DLVPRLALKTCCVLEKAGPEELETLEAVLNFKYSGGPGHTEGYYRNLSLGLHVEVEPSVFFTRVSTLPATSTRQCHLLLDVFNSTEHELTVSTRSSEALILHAGECQRMAIQVDKFNFESFPESPGEKGQFANPKQLEEERREARGLEIHSKLGICWRIPSLKRSGEASVEGLLNQLVLEHLQLAPLQWDVLVDGQPCDREAVAACQVGDPVRLEVRLTNRSPRSVGPFALTVVPFQDHQNGVHNYDLHDTVSFVGSSTFYLDAVQPSGQSACLGALLFLYTGDFFLHIRFHEDSTSKELPPSWFCLPSVHVCALEAQA

SEQ ID NO: 814376 - protein, 135 aa, Homo sapiens
MLFLFDVLVDGQPCDREAVAACQVGDPVRLEVRLTNRSPRSVGPFALTVVPFQDHQNGVHNYDLHDTVSFVGSSTFYLDAVQPSGQSACLGALLFLYTGDFFLHIRFHEDSTSKELPPSWFCLPSVHVCALEAQA

SEQ ID NO: 814377 - protein, 551 aa, Homo sapiens
LGRQSEAPAQSLGSGRRGCSAPLPARSWAPAPGPGPPAVDFKMSVPDYMQCAEDHQTLLVVVQPVGIVSEENFFRIYKRICSVSQISVRDSQRVLYIRYRHHYPPENNEWGDFQTHRKVVGLITITDCFSAKDWPQTFEKFHVQKEIYGSTLYDSRLFVFGLQGEIVEQPRTDVAFYPNYEDCQTVEKRIEDFIESLFIVLESKRLDRATDKSGDKIPLLCVPFEKKDFVGLDTDSRHYKKRCQGRMRKHVGDLCLQAGMLQDSLVHYHMSVELLRSVNDFLWLGAALEGLCSASVIYHYPGGTGGKSGARRFQGSTLPAEAANRHRPGAQEVLIDPGALTTNGINPDTSTEIGRAKNCLSPEDIIDKYKEAISYYSKYKNAGVIELEACIKAVRVLAIQKRSMEASEFLQNAVYINLRQLSEEEKIQRYSILSELYELIGFHRKSAFFKRVAAMQCVAPSIAEPGWRACYKLLLETLPGYSLSLDPKDFSRGTHRGWAAVQMRLLHELVYASRRMGNPALSVRHLSFLLQTMLDFLSDQEKKDVAQSLEN

SEQ ID NO: 814378 - protein, 575 aa, Homo sapiens
MSHAAEPARDGVEASAEGPRAVFVLLEERRPADSAQLLSLNSLLPESGIVADIELENVLDPDSFYELKSQPLPLRSSLPISLQATPATPATLSASSSAGGSRTPAMSSSSSSRVLLRQQLMRAQAQEQERRERREQAAAAPFPSPAPASPAISVVGVSAGGHTLSRPPPAQVPREVLKVQTHLENPTRYHLQQARRQQVKQYLSTTLGPKLASQALTPPPGPASAQPLPAPEAAHTTGPTGSAPNSPMALLTIGSSSEKEIDDVIDEIISLESSYNDEMLSYLPGGTTGLQLPSTLPVSGNLLDVYSSQGVATPAITVSNSCPAELPNIKREISETEAKALLKERQKKDNHNLIERRRRFNINDRIKELGTLIPKSSDPEMRWNKGTILKASVDYIRKLQKEQQRSKDLESRQRSLEQANRSLQLRIQELELQAQIHGLPVPPTPGLLSLATTSASDSLKPEQLDIEEEGRPGAATFHVGGGPAQNAPHQQPPAPPSDALLDLHFPSDHLGDLGDPFHLGLEDILMEEEEGVVGGLSGGALSPLRAASDPLLSSVSPAVSKASSRRSSFSMEEES

SEQ ID NO: 814379 - protein, 575 aa, Homo sapiens; identical to SEQ ID NO: 814378

SEQ ID NO: 814380 - protein, 470 aa, Homo sapiens
MSSSSSSRVLLRQQLMRAQAQEQERRERREQAAAAPFPSPAPASPAISVVGVSAGGHTLSRPPPAQVPREVLKVQTHLENPTRYHLQQARRQQVKQYLSTTLGPKLASQALTPPPGPASAQPLPAPEAAHTTGPTGSAPNSPMALLTIGSSSEKEIDDVIDEIISLESSYNDEMLSYLPGGTTGLQLPSTLPVSGNLLDVYSSQGVATPAITVSNSCPAELPNIKREISETEAKALLKERQKKDNHNLIERRRRFNINDRIKELGTLIPKSSDPEMRWNKGTILKASVDYIRKLQKEQQRSKDLESRQRSLEQANRSLQLRIQELELQAQIHGLPVPPTPGLLSLATTSASDSLKPEQLDIEEEGRPGAATFHVGGGPAQNAPHQQPPAPPSDALLDLHFPSDHLGDLGDPFHLGLEDILMEEEEGVVGGLSGGALSPLRAASDPLLSSVSPAVSKASSRRSSFSMEEES

SEQ ID NO: 814381 - protein, 575 aa, Homo sapiens; identical to SEQ ID NO: 814378

SEQ ID NO: 814382 - protein, 470 aa, Homo sapiens; identical to SEQ ID NO: 814380

SEQ ID NO: 814383 - protein, 470 aa, Homo sapiens; identical to SEQ ID NO: 814380

SEQ ID NO: 814384 - protein, 575 aa, Homo sapiens; identical to SEQ ID NO: 814378

SEQ ID NO: 814385 - protein, 326 aa, Homo sapiens
RDPQQEQERERIDDVIDEIISLESSYNDEMLSYLPGGTTGLQLPSTLPVSGNLLDVYSSQGVATPAITVSNSCPAELPNIKREISETEAKALLKERQKKDNHNLIERRRRFNINDRIKELGTLIPKSSDPEMRWNKGTILKASVDYIRKLQKEQQRSKDLESRQRSLEQANRSLQLRIQELELQAQIHGLPVPPTPGLLSLATTSASDSLKPEQLDIEEEGRPGAATFHVGGGPAQNAPHQQPPAPPSDALLDLHFPSDHLGDLGDPFHLGLEDILMEEEEGVVGGLSGGALSPLRAASDPLLSSVSPAVSKASSRRSSFSMEEES

SEQ ID NO: 814386 - protein, 291 aa, Homo sapiens
RDPQQEQERERLPVSGNLLDVYSSQGVATPAITVSNSCPAELPNIKREISETEAKALLKERQKKDNHNLIERRRRFNINDRIKELGTLIPKSSDPEMRWNKGTILKASVDYIRKLQKEQQRSKDLESRQRSLEQANRSLQLRIQELELQAQIHGLPVPPTPGLLSLATTSASDSLKPEQLDIEEEGRPGAATFHVGGGPAQNAPHQQPPAPPSDALLDLHFPSDHLGDLGDPFHLGLEDILMEEEEGVVGGLSGGALSPLRAASDPLLSSVSPAVSKASSRRSSFSMEEES

SEQ ID NO: 814387 - protein, 195 aa, Homo sapiens [sequence omitted]

SEQ ID NO: 814388 - protein, 198 aa, Homo sapiens
MRPCTFPKGTAQCRYFRRRRLEKDMRSGPAPWGSQPHPCPCGTHPCPGEGRRQDEVSTLSPRDCPSQVSWEREMSGCCSILCLGTTSLVRPGTEEESSNGGPCPALPRQGTEVRMRPSPFPWELSWPSRNGGARPHPFPIGTAQHRYFRCERISRTRPPLVLVEITAPPLSLSNIPSKHSTLQGGVVLKLPCLNLGPT

SEQ ID NO: 814389 - protein, 135 aa, Homo sapiens [sequence omitted]

SEQ ID NO: 814390 - protein, 575 aa, Homo sapiens; identical to SEQ ID NO: 814378

SEQ ID NO: 814391 - protein, 575 aa, Homo sapiens; identical to SEQ ID NO: 814378

SEQ ID NO: 814392 - protein, 500 aa, Homo sapiens
MSHAAEPARDGVEASAEGPRAVFVLLEERRPADSAQLLSLNSLLPESGIVADIELENVLDPDSFYELKSQPLPLRSSLPISLQATPATPATLSASSSAGGSRTPAMSSSSSSRVLLRQQLMRAQAQEQERRERREQAAAAPFPSPAPASPAISVVGVSAGGHTLSRPPPAQVPREVLKVQTHLENPTRYHLQQARRQQVKQYLSTTLGPKLASQALTPPPGPASAQPLPAPEAAHTTGPTGSAPNSPMALLTIGSSSEKEIDDVIDEIISLESSYNDEMLSYLPGGTTGLQLPSTLPVSGNLLDVYSSQGVATPAITVSNSCPAELPNIKREISETEAKALLKERQKKDNHNLIERRRRFNINDRIKELGTLIPKSSDPEMRWNKGTILKASVDYIRKLQKEQQRSKDLESRQRSLEQANRSLQLRIQELELQAQIHGLPVPPTPGLLSLATTSASDSLKPEQLDIEEEGRPGAATFHVGGGPAQNAPHQQLAPELAARP

SEQ ID NO: 814393 - protein, 379 aa, Homo sapiens
MSHAAEPARDGVEASAEGPRAVFVLLEERRPADSAQLLSLNSLLPESGIVADIELENVLDPDSFYELKSQPLPLRSSLPISLQATPATPATLSASSSAGGSRTPAMSSSSSSRVLLRQQLMRAQAQEQERRERREQAAAAPFPSPAPASPAISVVGVSAGGHTLSRPPPAQVPREVLKVQTHLENPTRYHLQQARRQQVKQYLSTTLGPKLASQALTPPPGPASAQPLPAPEAAHTTGPTGSAPNSPMALLTIGSSSEKEIDDVIDEIISLESSYNDEMLSYLPGGTTGLQLPSTLPVSGNLLDVYSSQGVATPAITVSNSCPAELPNIKREISETEAKALLKERQKKDNHNLIERRRRFNINDRIKELGTLIPKSSDP

SEQ ID NO: 814394 - protein, 410 aa, Homo sapiens
MSHAAEPARDGVEASAEGPRAVFVLLEERRPADSAQLLSLNSLLPESGIVADIELENVLDPDSFYELKSQPLPLRSSLPISLQATPATPATLSASSSAGGSRTPAMSSSSSSRVLLRQQLMRAQAQEQERRERREQAAAAPFPSPAPASPAISVVGVSAGGHTLSRPPPAQVPREVLKVQTHLENPTRYHLQQARRQQVKQYLSTTLGPKLASQALTPPPGPASAQPLPAPEAAHTTGPTGSAPNSPMALLTIGSSSEKEIDDVIDEIISLESSYNDEMLSYLPGGTTGLQLPSTAGAQWCYLGSLEPPPTKFKRFSCLSLLSNWDYSCLCQGICLMCTVVKAWPHQPSLSATPAQLSCPTSNGRSLTGAKPLQDRDTELTSKLIERRRRFNINDRIKELGTLIPKSSDP

SEQ ID NO: 814395 - protein, 298 aa, Homo sapiens
MSHAAEPARDGVEASAEGPRAVFVLLEERRPADSAQLLSLNSLLPESGIVADIELENVLDPDSFYELKSQPLPLRSSLPISLQATPATPATLSASSSAGGSRTPAMSSSSSSRVLLRQQLMRAQAQEQERRERREQAAAAPFPSPAPASPAISVVGVSAGGHTLSRPPPAQVPREVLKVQTHLENPTRYHLQQARRQQVKQYLSTTLGPKLASQALTPPPGPASAQPLPAPEAAHTTGPTGSAPNSPMALLTIGSSSEKEIDDVIDEIISLESSYNDEMLSYLPGGTTGLQLPSTVRP

SEQ ID NO: 814396 - protein, 330 aa, Homo sapiens
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSSSATASQPPESLPQPGLQKSVSNLQKPTQSISQENTNSVPGGPKSWAQLNGKPVGHEGGLRGSSRLLSFSPEEFPTLKAAGGQDKAGKEKGVLDLSYGPGPSLRPQNVTSWREGGGRHIISATSLSTSPTELGSRNSSTGDGAPSSACTSDSKDPSLRPAQPVRKGASQFMGNVYHPPTYHDMLPAFMCSPKSSENQGTVERGSFPLPQLRLEPRVPFRQFQMNDQDGIMVL

SEQ ID NO: 814397 - protein, 592 aa, Homo sapiens
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSSSATASQPPESLPQPGLQKSVSNLQKPTQSISQENTNSVPGGPKSWAQLNGKPVGHEGGLRGSSRLLSFSPEEFPTLKAAGGQDKAGKEKGVLDLSYGPGPSLRPQNVTSWREGGGRHIISATSLSTSPTELGSRNSSTGDGAPSSACTSDSKDPSLRPAQPVRKGASQFMGNVYHPPTYHDMLPAFMCSPKSSENQGTVERGSFPLPQLRLEPRVPFRQFQMNDQDGKENRLGLSRPLRPLRQLVERAPRPTIINAENLKGLDDLDADADDGWAGLHEEVDYSEKLKFSDDEEEEEVVKDGRPKWNSWDPRRQRQLSMSSADSADAKRTREEGKDWAEAVGASRVVRKAPDPQPPPRKLHGWAPGPDYQKSSMGSMFRQQSIEDKEDKPPPRQKFIQSEMSEAVERARKRREEEERRAREERLAACAAKLKQLDQKCKQARKAGEARKQAEKEVPWSPSAEKASPQENGPAVHKGSPEFLPKMPPPQDPLDTT

SEQ ID NO: 814398 - protein, 649 aa, Homo sapiens
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSSSATASQPPESLPQPGLQKSVSNLQKPTQSISQENTNSVPGGPKSWAQLNGKPVGHEGGLRGSSRLLSFSPEEFPTLKAAGGQDKAGKEKGVLDLSYGPGPSLRPQNVTSWREGGGRHIISATSLSTSPTELGSRNSSTGDGAPSSACTSDSKDPSLRPAQPVRKGASQFMGNVYHPPTYHDMLPAFMCSPKSSENQGTVERGSFPLPQLRLEPRVPFRQFQMNDQDGKENRLGLSRPLRPLRQLVERAPRPTIINAENLKGLDDLDADADDGWAGLHEEVDYSEKLKFSDDEEEEEVVKDGRPKWNSWDPRRQRQLSMSSADSADAKRTREEGKDWAEAVGASRVVRKAPDPQPPPRKLHGWAPGPDYQKSSMGSMFRQQSIEDKEDKPPPRQKFIQSEMSEAVERARKRREEEERRAREERLAACAAKLKQLDQKCKQARKAGEARKQAEKEVPWSPSAEKASPQENGPAVHKGSPEFPAQETPTTFPEEAPTVSPAVAQSNSSEEEAREAGSPAQEFKYQILSRSSAHTHTEHLQVTLHVTDSLKIVA

SEQ ID NO: 814399 - protein, 659 aa, Homo sapiens
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSSSATASQPPESLPQPGLQKSVSNLQKPTQSISQENTNSVPGGPKSWAQLNGKPVGHEGGLRGSSRLLSFSPEEFPTLKAAGGQDKAGKEKGVLDLSYGPGPSLRPQNVTSWREGGGRHIISATSLSTSPTELGSRNSSTGDGAPSSACTSDSKDPSLRPAQPVRKGASQFMGNVYHPPTYHDMLPAFMCSPKSSENQGTVERGSFPLPQLRLEPRVPFRQFQMNDQDGKENRLGLSRPLRPLRQLVERAPRPTIINAENLKGLDDLDADADDGWAGLHEEVDYSEKLKFSDDEEEEEVVKDGRPKWNSWDPRRQRQLSMSSADSADAKRTREEGKDWAEAVGASRVVRKAPDPQPPPRKLHGWAPGPDYQKSSMGSMFRQQSIEDKEDKPPPRQKFIQSEMSEAVERARKRREEEERRAREERLAACAAKLKQLDQKCKQARKAGEARKQAEKEVPWSPSAEKASPQENGPAVHKGSPEFPAQETPTTFPEEAPTVSPAVAQSNSSEEEAREAGSPAQEFKYQKSLPPRFQRQQQQQQQEQLYKMQHWQPVYPPPSHPQRT

SEQ ID NO: 814400 - protein, 444 aa, Homo sapiens
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSSSATASQPPESLPQPGLQKSVSNLQKPTQSISQENTNSVPGGPKSWAQLNGKPVGHEGGLRGSSRLLSFSPEEFPTLKAAGGQDKAGKEKGVLDLSYGPGPSLRPQNVTSWREGGGRHIISATSLSTSPTELGSRNSSTGDGAPSSACTSDSKDPSLRPAQPVRKGASQFMGNVYHPPTYHDMLPAFMCSPKSSENQGTVERGSFPLPQLRLEPRVPFRQFQMNDQDGKENRLGLSRPLRPLRQLVERAPRPTIINAENLKGLDDLDADADDGWAGGQRSTGGLDGQDQSPSVLTRDGNPLAPPCVFPWQDRDEEPDREADLMPSFLIYSLTSGSFLAKPLASFGL

SEQ ID NO: 814401 - protein, 234 aa, Homo sapiens
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSSSATASQPPESLPQPGLQKSVSNLQKPTQSISQENTNSVPGGPKSWAQLNGKPVGHEGGLRGSSRLLSFSPEEFPTLKAAGGQDKAGKEKGVLDLSYGPCWPLRAALPHKVYSGGALLPLQKRTHPWHMQNFIVKR

SEQ ID NO: 814402 - protein, 174 aa, Homo sapiens
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSSSATASQPPESLPQPGLQKSVSNLQKPTQSISQENTNSVPGGPKSWAQLNGKPVGHEGGKCARECVAWFRWGEGGE

SEQ ID NO: 814403 - protein, 41 aa, Homo sapiens
MGQDQASALRVSDCSLWALDGVTELPPLISLHSYKGADATG

SEQ ID NO: 814404 - protein, 80 aa, Homo sapiens
IRRAAVELLRPARQPPPNARWGRGVSESQRHQGPCDKVAAARPGASGRRSGFGSVTRRPEGAGPAFSARAPGPCRSRFAS

SEQ ID NO: 814405 - protein, 218 aa, Homo sapiens
MVPQRGSRPHYGGERLYHQHSTPSATPGAATAPIISPTKRAREPRGENKHAPVHQAEAHPSLRRTKRTRQQIGQAGQCDAHNRRAATHSTPSHQRNRSTPQTPPPTRRHTHTPTPPPSPDGRQQHPRRRHQQPAQPATQSARPAPARGRTDQTIRAPHHPSAGEAPQHSPSSTPHTDVCHPRRPREHHRPRTGQQTPPELHRTHQARHRRHAHPHAPP

SEQ ID NO: 814406 - protein, 80 aa, Homo sapiens; identical to SEQ ID NO: 814404

SEQ ID NO: 814407 - protein, 80 aa, Homo sapiens; identical to SEQ ID NO: 814404

SEQ ID NO: 814408 - protein, 80 aa, Homo sapiens; identical to SEQ ID NO: 814404

SEQ ID NO: 814409 - protein, 218 aa, Homo sapiens; identical to SEQ ID NO: 814405

SEQ ID NO: 814410 - protein, 94 aa, Homo sapiens
QFEETLRITWDSESISENFPQKYVDPLAGAADGKEKNIGNEQAEDVFYIPSCMSGSRNFKMAKLEDTRNVGMPVAHMESPERVSVELVRRRLSL

SEQ ID NO: 814411 - protein, 1709 aa, Homo sapiens
MKKIFSKKGESPLGSFARRRRSSAGGGGEPGEGAYSQPGYHVRDRDLGKIHKAASAGNVAKVQQILLLRKNGLNDRDKMNRTALHLACANGHPEVVTLLVDRKCQLNVCDNENRTALMKAVQCQEEKCATILLEHGADPNLADVHGNTALHYAVYNEDISVATKLLLYDANIEAKNKDDLTPLLLAVSGKKQQMVEFLIKKKANVNAVDKLESSHQLISEYKEERIPKHSSQNSNSVDESSEDSLSRLSGKPGVDDSWPTSDDEDLNFDTKNVPKPSLAKLMTASQQSRKNLEATYGTVRTGNRTLFEDRDSDSQDEVVVESLPTTSIKVQCFSHPTYQSPDLLPKPSHKSLANPGLMKEEPTKPGIAKKENGIDIIESAPLEQTNNDNLTYVDEVHKNNRSDMMSALGLGQEEDIESPWDSESISENFPQKYVDPLAGAADGKEKNIGNEQAEDVFYIPSCMSGSRNFKMAKLEDTRNVGMPVAHMESPERYLHLKPTIEMKDSVPNKAGGMKDVQTSKAAEHDLEVASEEEQEREGSENNQPQVEEERKKHRNNEMEVSANIHDGATDDAEDDDDDDGLIQKRKSGETDHQQFPRKENKEYASGPALQMKEVKSTEKEKRTSKESVNSPVFGKASLLTGGLLQVDDDSSLSEIDEDEGRPTKKTSNEKNKVKNQIQSMDDVDDLTQSSETASEDCELPHSSYKNFMLLIEQLGMECKDSVSLLKIQDAALSCERLLELKKNHCELLTVKIKKMEDKVNVLQRELSETKEIKSQLEHQKVEWERELCSLRFSLNQEEEKRRNADTLYEKIREQLRRKEEQYRKEVEVKQQLELSLQTLEMELRTVKSNLNQVVQERNDAQRQLSREQNARMLQDGILTNHLSKQKEIEMAQKKMNSENSHSHEEEKDLSHKNSMLQEEIAMLRLEIDTIKNQNQEKEKKCFEDLKIVKEKNEDLQKTIKQNEETLTQTISQYNGRLSVLTAENAMLNSKLENEKQSKERLEAEVESYHSRLAAAIHDRDQSETSKRELELAFQRARDECSRLQDKMNFDVSNLKDNNEILSQQLFKTESKLNSLEIEFHHTRDALREKTLGLERVQKDLSQTQCQMKEMEQKYQNEQVKVNKYIGKQESVEERLSQLQSENMLLRQQLDDAHNKADNKEKTVINIQDQFHAIVQKLQAESEKQSLLLEERNKELISECNHLKERQYQYENEKAEREVVVRQLQQELADTLKKQSMSEASLEVTSRYRINLEDETQDLKKKLGQIRNQLQEAQDRHTEAVRCAEKMQDHKQKLEKDNAKLKVTVKKQMDKIEELQKNLLNANLSEDEKEQLKKLMELKQSLECNLDQEMKKNVELEREITGFKNLLKMTRKKLNEYENGEFSFHGDLKTSQFEMDIQINKLKHKIDDLTAELETAGSKCLHLDTKNQILQEELLSMKTVQKKCEKLQKNKKKLEQEVINLRSHIERNMVELGQVKQYKQEIEERARQEIAEKLKEVNLFLQAQAASQENLEQFRENNFASMKSQMELRIKDLESELSKIKTSQEDFNKTELEKYKQLYLEELKVRKSLSSKLTKTNERLAEVNTKLLVEKQQSRSLFTTLTTRPVMEPPCVGNLNNSLDLNRKLIPRENLVISTSNPRASNNSMENYLSKMQQELEKNITRELKEAAAELESGSIASPLGSTDESNLNQDLVWKASREYVQVLKKNYMI

SEQ ID NO: 814412 - protein, 1709 aa, Homo sapiens; identical to SEQ ID NO: 814411

SEQ ID NO: 814413 - protein, 1749 aa, Homo sapiens
MKKIFSKKGESPLGSFARRRRSSAGGGGEPGEGAYSQPGYHVRDRDLGKIHKAASAGNVAKVQQILLLRKNGLNDRDKMNRTALHLACANGHPEVVTLLVDRKCQLNVCDNENRTALMKAVQCQEEKCATILLEHGADPNLADVHGNTALHYAVYNEDISVATKLLLYDANIEAKNKDDLTPLLLAVSGKKQQMVEFLIKKKANVNAVDKLESSHQLISEYKEERIPKHSSQNSNSVDESSEDSLSRLSGKPGVDDSWPTSDDEDLNFDTKNVPKPSLAKLMTASQQSRKNLEATYGTVRTGNRTLFEDRDSDSQDEVVVESLPTTSIKVQCFSHPTYQSPDLLPKPSHKSLANPGLMKEEPTKPGIAKKENGIDIIESAPLEQTNNDNLTYVDEVHKNNRSDMMSALGLGQEEDIESPWDSESISENFPQKYVDPLAGAADGKEKNIGNEQAEDVFYIPSCMSGSRNFKMAKLEDTRNVGMPVAHMESPERYLHLKPTIEMKDSVPNKAGGMKDVQTSKAAEHDLEVASEEEQEREGSENNQPQVEEERKKHRNNEMEVSANIHDGATDDAEDDDDDDGLIQKRKSGETDHQQFPRKENKEYASGPALQMKEVKSTEKEKRTSKESVNSPVFGKASLLTGGLLQVDDDSSLSEIDEDEGRPTKKTSNEKNKVKNQIQSMDDVDDLTQSSETASEDCELPHSSYKNFMLLIEQLGMECKDSVSLLKIQDAALSCERLLELKKNHCELLTVKIKKMEDKVNVLQRELSETKEIKSQLEHQKVEWERELCSLRFSLNQEEEKRRNADTLYEKIREQLRRKEEQYRKEVEVKQQLELSLQTLEMELRTVKSNLNQSLKQNCYLKLTCDLYNYKLFMIILAPNRCLVSVFCMKEWRVVQERNDAQRQLSREQNARMLQDGILTNHLSKQKEIEMAQKKMNSENSHSHEEEKDLSHKNSMLQEEIAMLRLEIDTIKNQNQEKEKKCFEDLKIVKEKNEDLQKTIKQNEETLTQTISQYNGRLSVLTAENAMLNSKLENEKQSKERLEAEVESYHSRLAAAIHDRDQSETSKRELELAFQRARDECSRLQDKMNFDVSNLKDNNEILSQQLFKTESKLNSLEIEFHHTRDALREKTLGLERVQKDLSQTQCQMKEMEQKYQNEQVKVNKYIGKQESVEERLSQLQSENMLLRQQLDDAHNKADNKEKTVINIQDQFHAIVQKLQAESEKQSLLLEERNKELISECNHLKERQYQYENEKAEREVVVRQLQQELADTLKKQSMSEASLEVTSRYRINLEDETQDLKKKLGQIRNQLQEAQDRHTEAVRCAEKMQDHKQKLEKDNAKLKVTVKKQMDKIEELQKNLLNANLSEDEKEQLKKLMELKQSLECNLDQEMKKNVELEREITGFKNLLKMTRKKLNEYENGEFSFHGDLKTSQFEMDIQINKLKHKIDDLTAELETAGSKCLHLDTKNQILQEELLSMKTVQKKCEKLQKNKKKLEQEVINLRSHIERNMVELGQVKQYKQEIEERARQEIAEKLKEVNLFLQAQAASQENLEQFRENNFASMKSQMELRIKDLESELSKIKTSQEDFNKTELEKYKQLYLEELKVRKSLSSKLTKTNERLAEVNTKLLVEKQQSRSLFTTLTTRPVMEPPCVGNLNNSLDLNRKLIPRENLVISTSNPRASNNSMENYLSKMQQELEKNITRELKEAAAELESGSIASPLGSTDESNLNQDLVWKASREYVQVLKKNYMI

SEQ ID NO: 814414 - protein, 1718 aa, Homo sapiens
MKKIFSKKGESPLGSFARRRRSSAGGGGEPGEGAYSQPGYHVRDRDLGKIHKAASAGNVAKVQQILLLRKNGLNDRDKMNRTALHLACANGHPEVVTLLVDRKCQLNVCDNENRTALMKAVQCQEEKCATILLEHGADPNLADVHGNTALHYAVYNEDISVATKLLLYDANIEAKNKDDLTPLLLAVSGKKQQMVEFLIKKKANVNAVDKLESSHQLISEYKEERIPKHSSQNSNSVDESSEDSLSRLSGKPGVDDSWPTSDDEDLNFDTKNVPKPSLAKLMTASQQSRKNLEATYGTVRTGNRTLFEDRDSDSQDEVVVESLPTTSIKVQCFSHPTYQSPDLLPKPSHKSLANPGLMKEEPTKPGIAKKENGIDIIESAPLEQTNNDNLTYVDEVHKNNRSDMMSALGLGQEEDIESPWDSESISENFPQKYVDPLAGAADGKEKNIGNEQAEDVFYIPSCMSGSRNFKMAKLEDTRNVGMPVAHMESPERYLHLKPTIEMKDSVPNKAGGMKDVQTSKAAEHDLEVASEEEQEREGSENNQPQVEEERKKHRNNEMEVSANIHDGATDDAEDDDDDDGLIQKRKSGETDHQQFPRKENKEYASGPALQMKEVKSTEKEKRTSKESVNSPVFGKASLLTGGLLQVDDDSSLSEIDEDEGRPTKKTSNEKNKVKNQIQSMDDVDDLTQSSETASEDCELPHSSYKNFMLLIEQLGMECKDSVSLLKIQDAALSCERLLELKKNHCELLTVKIKKMEDKVNVLQRELSETKEIKSQLEHQKVEWERELCSLRFKINIFNCRFSLNQEEEKRRNADTLYEKIREQLRRKEEQYRKEVEVKQQLELSLQTLEMELRTVKSNLNQVVQERNDAQRQLSREQNARMLQDGILTNHLSKQKEIEMAQKKMNSENSHSHEEEKDLSHKNSMLQEEIAMLRLEIDTIKNQNQEKEKKCFEDLKIVKEKNEDLQKTIKQNEETLTQTISQYNGRLSVLTAENAMLNSKLENEKQSKERLEAEVESYHSRLAAAIHDRDQSETSKRELELAFQRARDECSRLQDKMNFDVSNLKDNNEILSQQLFKTESKLNSLEIEFHHTRDALREKTLGLERVQKDLSQTQCQMKEMEQKYQNEQVKVNKYIGKQESVEERLSQLQSENMLLRQQLDDAHNKADNKEKTVINIQDQFHAIVQKLQAESEKQSLLLEERNKELISECNHLKERQYQYENEKAEREVVVRQLQQELADTLKKQSMSEASLEVTSRYRINLEDETQDLKKKLGQIRNQLQEAQDRHTEAVRCAEKMQDHKQKLEKDNAKLKVTVKKQMDKIEELQKNLLNANLSEDEKEQLKKLMELKQSLECNLDQEMKKNVELEREITGFKNLLKMTRKKLNEYENGEFSFHGDLKTSQFEMDIQINKLKHKIDDLTAELETAGSKCLHLDTKNQILQEELLSMKTVQKKCEKLQKNKKKLEQEVINLRSHIERNMVELGQVKQYKQEIEERARQEIAEKLKEVNLFLQAQAASQENLEQFRENNFASMKSQMELRIKDLESELSKIKTSQEDFNKTELEKYKQLYLEELKVRKSLSSKLTKTNERLAEVNTKLLVEKQQSRSLFTTLTTRPVMEPPCVGNLNNSLDLNRKLIPRENLVISTSNPRASNNSMENYLSKMQQELEKNITRELKEAAAELESGSIASPLGSTDESNLNQDLVWKASREYVQVLKKNYMI

SEQ ID NO: 814415 - protein, 1428 aa, Homo sapiens
MTASQQSRKNLEATYGTVRTGNRTLFEDRDSDSQDEVVVESLPTTSIKVQCFSHPTYQSPDLLPKPSHKSLANPGLMKEEPTKPGIAKKENGIDIIESAPLEQTNNDNLTYVDEVHKNNRSDMMSALGLGQEEDIESPWDSESISENFPQKYVDPLAGAADGKEKNIGNEQAEDVFYIPSCMSGSRNFKMAKLEDTRNVGMPVAHMESPERYLHLKPTIEMKDSVPNKAGGMKDVQTSKAAEHDLEVASEEEQEREGSENNQPQVEEERKKHRNNEMEVSANIHDGATDDAEDDDDDDGLIQKRKSGETDHQQFPRKENKEYASGPALQMKEVKSTEKEKRTSKESVNSPVFGKASLLTGGLLQVDDDSSLSEIDEDEGRPTKKTSNEKNKVKNQIQSMDDVDDLTQSSETASEDCELPHSSYKNFMLLIEQLGMECKDSVSLLKIQDAALSCERLLELKKNHCELLTVKIKKMEDKVNVLQRELSETKEIKSQLEHQKVEWERELCSLRFSLNQEEEKRRNADTLYEKIREQLRRKEEQYRKEVEVKQQLELSLQTLEMELRTVKSNLNQVVQERNDAQRQLSREQNARMLQDGILTNHLSKQKEIEMAQKKMNSENSHSHEEEKDLSHKNSMLQEEIAMLRLEIDTIKNQNQEKEKKCFEDLKIVKEKNEDLQKTIKQNEETLTQTISQYNGRLSVLTAENAMLNSKLENEKQSKERLEAEVESYHSRLAAAIHDRDQSETSKRELELAFQRARDECSRLQDKMNFDVSNLKDNNEILSQQLFKTESKLNSLEIEFHHTRDALREKTLGLERVQKDLSQTQCQMKEMEQKYQNEQVKVNKYIGKQESVEERLSQLQSENMLLRQQLDDAHNKADNKEKTVINIQDQFHAIVQKLQAESEKQSLLLEERNKELISECNHLKERQYQYENEKAEREVVVRQLQQELADTLKKQSMSEASLEVTSRYRINLEDETQDLKKKLGQIRNQLQEAQDRHTEAVRCAEKMQDHKQKLEKDNAKLKVTVKKQMDKIEELQKNLLNANLSEDEKEQLKKLMELKQSLECNLDQEMKKNVELEREITGFKNLLKMTRKKLNEYENGEFSFHGDLKTSQFEMDIQINKLKHKIDDLTAELETAGSKCLHLDTKNQILQEELLSMKTVQKKCEKLQKNKKKLEQEVINLRSHIERNMVELGQVKQYKQEIEERARQEIAEKLKEVNLFLQAQAASQENLEQFRENNFASMKSQMELRIKDLESELSKIKTSQEDFNKTELEKYKQLYLEELKVRKSLSSKLTKTNERLAEVNTKLLVEKQQSRSLFTTLTTRPVMEPPCVGNLNNSLDLNRKLIPRENLVISTSNPRASNNSMENYLSKMQQELEKNITRELKEAAAELESGSIASPLGSTDESNLNQDLVWKASREYVQVLKKNYMI

SEQ ID NO: 814416 - protein, 1463 aa, Homo sapiens
RTGCAISHLTFFQTFPQVVSNPGLMNVPKPSLAKLMTASQQSRKNLEATYGTVRTGNRTLFEDRDSDSQDEVVVESLPTTSIKVQCFSHPTYQSPDLLPKPSHKSLANPGLMKEEPTKPGIAKKENGIDIIESAPLEQTNNDNLTYVDEVHKNNRSDMMSALGLGQEEDIESPWDSESISENFPQKYVDPLAGAADGKEKNIGNEQAEDVFYIPSCMSGSRNFKMAKLEDTRNVGMPVAHMESPERYLHLKPTIEMKDSVPNKAGGMKDVQTSKAAEHDLEVASEEEQEREGSENNQPQVEEERKKHRNNEMEVSANIHDGATDDAEDDDDDDGLIQKRKSGETDHQQFPRKENKEYASGPALQMKEVKSTEKEKRTSKESVNSPVFGKASLLTGGLLQVDDDSSLSEIDEDEGRPTKKTSNEKNKVKNQIQSMDDVDDLTQSSETASEDCELPHSSYKNFMLLIEQLGMECKDSVSLLKIQDAALSCERLLELKKNHCELLTVKIKKMEDKVNVLQRELSETKEIKSQLEHQKVEWERELCSLRFSLNQEEEKRRNADTLYEKIREQLRRKEEQYRKEVEVKQQLELSLQTLEMELRTVKSNLNQVVQERNDAQRQLSREQNARMLQDGILTNHLSKQKEIEMAQKKMNSENSHSHEEEKDLSHKNSMLQEEIAMLRLEIDTIKNQNQEKEKKCFEDLKIVKEKNEDLQKTIKQNEETLTQTISQYNGRLSVLTAENAMLNSKLENEKQSKERLEAEVESYHSRLAAAIHDRDQSETSKRELELAFQRARDECSRLQDKMNFDVSNLKDNNEILSQQLFKTESKLNSLEIEFHHTRDALREKTLGLERVQKDLSQTQCQMKEMEQKYQNEQVKVNKYIGKQESVEERLSQLQSENMLLRQQLDDAHNKADNKEKTVINIQDQFHAIVQKLQAESEKQSLLLEERNKELISECNHLKERQYQYENEKAEREVVVRQLQQELADTLKKQSMSEASLEVTSRYRINLEDETQDLKKKLGQIRNQLQEAQDRHTEAVRCAEKMQDHKQKLEKDNAKLKVTVKKQMDKIEELQKNLLNANLSEDEKEQLKKLMELKQSLECNLDQEMKKNVELEREITGFKNLLKMTRKKLNEYENGEFSFHGDLKTSQFEMDIQINKLKHKIDDLTAELETAGSKCLHLDTKNQILQEELLSMKTVQKKCEKLQKNKKKLEQEVINLRSHIERNMVELGQVKQYKQEIEERARQEIAEKLKEVNLFLQAQAASQENLEQFRENNFASMKSQMELRIKDLESELSKIKTSQEDFNKTELEKYKQLYLEELKVRKSLSSKLTKTNERLAEVNTKLLVEKQQSRSLFTTLTTRPVMEPPCVGNLNNSLDLNRKLIPRENLVISTSNPRASNNSMENYLSKMQQELEKNITRELKEAAAELESGSIASPLGSTDESNLNQDLVWKASREYVQVLKKNYMI

SEQ ID NO: 814417 - protein, 402 aa, Homo sapiens [sequence omitted]

SEQ ID NO: 814418 - protein, 1724 aa, Homo sapiens
MKKIFSKKGESPLGSFARRRRSSAGGGGEPGEGAYSQPGYHVRDRDLGKIHKAASAGNVAKVQQILLLRKNGLNDRDKMNRTALHLACANGHPEVVTLLVDRKCQLNVCDNENRTALMKAVQCQEEKCATILLEHGADPNLADVHGNTALHYAVYNEDISVATKLLLYDANIEAKNKDDLTPLLLAVSGKKQQMVEFLIKKKANVNAVDKLESSHQLISEYKEERIPKHSSQNSNSVDESSEDSLSRLSGKPGVDDSWPTSDDEDLNFDTKNVPKPSLAKLMTASQQSRKNLEATYGTVRTGNRTLFEDRDSDSQDEVVVESLPTTSIKVQCFSHPTYQSPDLLPKPSHKSLANPGLMKEEPTKPGIAKKENGIDIIESAPLEQTNNDNLTYVDEVHKNNRSDMMSALGLGQEEDIESPWDSESISENFPQKYVDPLAGAADGKEKNIGNEQAEDVFYIPSCMSGSRNFKMAKLEDTRNVGMPVAHMESPERYLHLKPTIEMKDSVPNKAGGMKDVQTSKAAEHDLEVASEEEQEREGSENNQPQVEEERKKHRNNEMEVSANIHDGATDDAEDDDDDDGLIQKRKSGETDHQQFPRKENKEYASGPALQMKEVKSTEKEKRTSKESVNSPVFGKASLLTGGLLQVDDDSSLSEIDEDEGRPTKKTSNEKNKVKNQIQSMDDVDDLTQSSETASEDCELPHSSYKNFMLLIEQLGMECKDSVSLLKIQDAALSCERLLELKKNHCELLTVKIKKMEDKVNVLQRELSETKEIKSQLEHQKVEWERELCSLRFSLNQEEEKRRNADTLYEKIREQLRRKEEQYRKEVEVKQQLELSLQTLEMELRTVKSNLNQVVQERNDAQRQLSREQNARMLQDGILTNHLSKQKEIEMAQKKMNSENSHSHEEEKDLSHKNSMLQEEIAMLRLEIDTIKNQNQEKEKKCFEDLKIVKEKNEDLQKTIKQNEETLTQTISQYNGRLSVLTAENAMLNSKLENEKQSKERLEAEVESYHSRLAAAIHDRDQSETSKRELELAFQRARDECSRLQDKMNFDVSNLKDNNEILSQQLFKTESKLNSLEIEFHHTRDALREKTLGLERVQKDLSQTQCQMKEMEQKYQNEQVKVNKYIGKQESVEERLSQLQSENMLLRQQLDDAHNKADNKEKTVINIQDQFHAIVQKLQAESEKQSLLLEERNKELISECNHLKERQYQYENEKAEREVVVRQLQQELADTLKKQSMSEASLEVTSRYRINLEDETQDLKKKLGQIRNQLQEAQDRHTEAVRCAEKMQDHKQKLEKDNAKLKVTVKKQMDKIEELQKNLLNANLSEDEKEQLKKLMELKQSLECNLDQEMKKNVELEREITGFKNLLKMTRKKLNEYENGEFSFHGDLKTSQFEMDIQINKLKHKIDDLTAELETAGSKCLHLDTKNQILQEELLSMKTVQKKCEKLQKNKKKLEQEVINLRSHIERNMVELGQVKQYKQEIEERARQEIAEKLKEVNLFLQAQAASQENLEQFRENNFASMKSQMELRIKDLESELSKIKTSQEDFNKTELEKYKQLYLEELKVRKSLSSKLTKTNERLAEVNTKLLVEKQQSRSLFTTLTTRPVMEPPCVGNLNNSLDLNRKLIPRENLVISTSNPRASNNSMENYLSKMQQELEKNITRELKEAAAELESGSIASPLGSTDESNLNQDLVWKASREYGPSDETPHDYVLMTDQCLTSRTDLQ

SEQ ID NO: 814419 - protein, 397 aa, Homo sapiens
MKKIFSKKGESPLGSFARRRRSSAGGGGEPGEGAYSQPGYHVRDRDLGKIHKAASAGNVAKVQQILLLRKNGLNDRDKMNRTALHLACANGHPEVVTLLVDRKCQLNVCDNENRTALMKAVQCQEEKCATILLEHGADPNLADVHGNTALHYAVYNEDISVATKLLLYDANIEAKNKDDLTPLLLAVSGKKQQMVEFLIKKKANVNAVDKLESSHQLISEYKEERIPKHSSQNSNSVDESSEDSLSRLSGKPGVDDSWPTSDDEDLNFDTKNVPKPSLAKLMTASQQSRKNLEATYGTVRTGNRTLFEDRDSDSQDEVVVESLPTTSIKVQCFSHPTYQSPDLLPKPSHKSLANPGLMKVSCFLKNFFHVPFPCPNNPHNDASIEMIIQFLFLIMFM

SEQ ID NO: 814420 - protein, 800 aa, Homo sapiens
VLAGPRRSVPCCSTRCHSPAGRRARPPEPRRGCGTVGQRAQPSLGKRQQSQRGDGERAKLTSLPPTLRPSCPEGLQPAVCRACLCARGAAPGRRPGAELFPQGGSAAQPRGSGGLATQDPAPQPRTPSGGEVWLLSGAAPDHWTAGAMPVGGLLPLFSSPAGGVLGGGLGGGGGRKGSGPAALRLTEKFVLLLVFSAFITLCFGAIFFLPDSSKLLSGVLFHSSPALQPAADHKPGPGARAEDAAEGRARRREEGAPGDPEAALEDNLARIRENHERALREAKETLQKLPEEIQRDILLEKKKVAQDQLRDKAPFRGLPPVDFVPPIGVESREPADAAIREKRAKIKEMMKHAWNNYKGYAWGLNELKPISKGGHSSSLFGNIKGATIVDALDTLFIMEMKHEFEEAKSWVEENLDFNVNAEISVFEVNIRFVGGLLSAYYLSGEEIFRKKAVELGVKLLPAFHTPSGIPWALLNMKSGIGRNWPWASGGSSILAEFGTLHLEFMHLSHLSGNPIFAEKVMNIRTVLNKLEKPQGLYPNYLNPSSGQWGQHHVSVGGLGDSFYEYLLKAWLMSDKTDLEAKKMYFDAVQAIETHLIRKSSSGLTYIAEWKGGLLEHKMGHLTCFAGGMFALGADAAPEGMAQHYLELGAEIARTCHESYNRTFMKLGPEAFRFDGGVEAIATRQNEKYYILRPEVMETYMYMWRLTHDPKYRKWAWEAVEALENHCRVNGGYSGLRDVYLLHESYDDVQQSFFLAETLKYLYLIFSDDDLLPLEHWIFNSEAHLLPILPKDKKEVEIREE

SEQ ID NO: 814421 - protein, 614 aa, Homo sapiens
MSLLPSNLFSAFITLCFGAIFFLPDSSKLLSGVLFHSSPALQPAADHKPGPGARAEDAAEGRARRREEGAPGDPEAALEDNLARIRENHERALREAKETLQKLPEEIQRDILLEKKKVAQDQLRDKAPFRGLPPVDFVPPIGVESREPADAAIREKRAKIKEMMKHAWNNYKGYAWGLNELKPISKGGHSSSLFGNIKGATIVDALDTLFIMEMKHEFEEAKSWVEENLDFNVNAEISVFEVNIRFVGGLLSAYYLSGEEIFRKKAVELGVKLLPAFHTPSGIPWALLNMKSGIGRNWPWASGGSSILAEFGTLHLEFMHLSHLSGNPIFAEKVMNIRTVLNKLEKPQGLYPNYLNPSSGQWGQHHVSVGGLGDSFYEYLLKAWLMSDKTDLEAKKMYFDAVQAIETHLIRKSSSGLTYIAEWKGGLLEHKMGHLTCFAGGMFALGADAAPEGMAQHYLELGAEIARTCHESYNRTFMKLGPEAFRFDGGVEAIATRQNEKYYILRPEVMETYMYMWRLTHDPKYRKWAWEAVEALENHCRVNGGYSGLRDVYLLHESYDDVQQSFFLAETLKYLYLIFSDDDLLPLEHWIFNSEAHLLPILPKDKKEVEIREE

SEQ ID NO: 814422 - protein, 614 aa, Homo sapiens; identical to SEQ ID NO: 814421

SEQ ID NO: 814423 - protein, 614 aa, Homo sapiens; identical to SEQ ID NO: 814421

SEQ ID NO: 814424 - protein, 464 aa, Homo sapiens
MYGEMEVCPFHQMMKHAWNNYKGYAWGLNELKPISKGGHSSSLFGNIKGATIVDALDTLFIMEMKHEFEEAKSWVEENLDFNVNAEISVFEVNIRFVGGLLSAYYLSGEEIFRKKAVELGVKLLPAFHTPSGIPWALLNMKSGIGRNWPWASGGSSILAEFGTLHLEFMHLSHLSGNPIFAEKVMNIRTVLNKLEKPQGLYPNYLNPSSGQWGQHHVSVGGLGDSFYEYLLKAWLMSDKTDLEAKKMYFDAVQAIETHLIRKSSSGLTYIAEWKGGLLEHKMGHLTCFAGGMFALGADAAPEGMAQHYLELGAEIARTCHESYNRTFMKLGPEAFRFDGGVEAIATRQNEKYYILRPEVMETYMYMWRLTHDPKYRKWAWEAVEALENHCRVNGGYSGLRDVYLLHESYDDVQQSFFLAETLKYLYLIFSDDDLLPLEHWIFNSEAHLLPILPKDKKEVEIREE

SEQ ID NO: 814425 - protein, 614 aa, Homo sapiens; identical to SEQ ID NO: 814421

SEQ ID NO: 814426 - protein, 446 aa, Homo sapiens
MYGEMEVCPFHQMMKHAWNNYKGYAWGLNELKPISKGGHSSSLFGNIKGATIVDALDTLFIMEMKHEFEEAKSWVEGFVGGLLSAYYLSGEEIFRKKAVELGVKLLPAFHTPSGIPWALLNMKSGIGRNWPWASGGSSILAEFGTLHLEFMHLSHLSGNPIFAEKVMNIRTVLNKLEKPQGLYPNYLNPSSGQWGQHHVSVGGLGDSFYEYLLKAWLMSDKTDLEAKKMYFDAVQAIETHLIRKSSSGLTYIAEWKGGLLEHKMGHLTCFAGGMFALGADAAPEGMAQHYLELGAEIARTCHESYNRTFMKLGPEAFRFDGGVEAIATRQNEKYYILRPEVMETYMYMWRLTHDPKYRKWAWEAVEALENHCRVNGGYSGLRDVYLLHESYDDVQQSFFLAETLKYLYLIFSDDDLLPLEHWIFNSEAHLLPILPKDKKEVEIREE

SEQ ID NO: 814427 - protein, 296 aa, Homo sapiens [sequence omitted]

SEQ ID NO: 814428 - protein, 464 aa, Homo sapiens; identical to SEQ ID NO: 814424

SEQ ID NO: 814429 - protein, 614 aa, Homo sapiens; identical to SEQ ID NO: 814421

SEQ ID NO: 814430 - protein, 614 aa, Homo sapiens; identical to SEQ ID NO: 814421

SEQ ID NO: 814431 - protein, 142 aa, Homo sapiens
MYGEMEVCPFHQMMKHAWNNYKGYAWGLNELKPISKGGHSSSLFGNIKGATIVDALDTLFIMEMKHEFEEAKSWVEENLDFNVNAEISVFEVNIRFVGGLLSAYYLSGEEIFRKKAVELGVKLLPAFHTPSGIPWALLNMKR

SEQ ID NO: 814432 - protein, 45 aa, Homo sapiens
MELFTVNKEKGKSLLLGPSSGGGSIPETVRGAASGVLCVADADPS

SEQ ID NO: 814433 - protein, 985 aa, Homo sapiens
QAAAWVAQLPGQRCLSRRVPCVRRGCRPPLPPLPGSQSRAWSRDREAPLDPGRPAQSGRRPTSRSVSHACSWNGGSLDPLEGTPALLRSAERLMRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDHFQATPHHGVYSREEELLRERKRLGVFGITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 814434 - protein, 822 aa, Homo sapiens
QAAAWVAQLPGQRCLSRRVPCVRRGCRPPLPPLPGSQSRAWSRDREAPLDPGRPAQSGRRPTSRSVSHACSWNGGSLDPLEGTPALLRSAERLMRKVKKLRLDKENTGSWRSFSLNSEGAERMATTGTPTADRGDAAATDDPAARFQVQKHSWDGLRSIIHGSRKYSGLIVNIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 814435 - protein, 711 aa, Homo sapiens
ALTRLCSFGVFALLGSLLMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 814436 - protein, 522 aa, Homo sapiens
DAWVDPRRPYIARSGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 814437 - protein, 515 aa, Homo sapiens
MVALGFKTAVTLYKWQKPVLHFIGAEKAELVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 814438 - protein, 466 aa, Homo sapiens
GITGVSHHARPPTPSDSIFYLLSGQVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 814439 - protein, 925 aa, Homo sapiens
QAAAWVAQLPGQRCLSRRVPCVRRGCRPPLPPLPGSQSRAWSRDREAPLDPGRPAQSGRRPTSRSVSHACSWNGGSLDPLEGTPALLRSAERLMRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDHFQATPHHGVYSREEELLRERKRLGVFGITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKAQPLAYPPRLPGRKRALFPHKLPRLPTDPSRETLPAPDLPQRETQYSLPRVGRAL

SEQ ID NO: 814440 - protein, 1025 aa, Homo sapiens
QAAAWVAQLPGQRCLSRRVPCVRRGCRPPLPPLPGSQSRAWSRDREAPLDPGRPAQSGRRPTSRSVSHACSWNGGSLDPLEGTPALLRSAERLMRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDHFQATPHHGVYSREEELLRERKRLGVFGITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNDVRMACPKEPPNPAFAFNPPTWRFPVFNRKKRCNTYIFRQAKAKNNGFPQFTVIPFPPKNLGKFPGNAQGGKTLPSSQIYPNERHSIRCPESGEHYEVTLLHFLQEYL

SEQ ID NO: 814441 - protein, 363 aa, Homo sapiens
WRIRHEGEVLARHGSKGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 814442 - protein, 985 aa, Homo sapiens; identical to SEQ ID NO: 814433

SEQ ID NO: 814443 - protein, 985 aa, Homo sapiens; identical to SEQ ID NO: 814433

SEQ ID NO: 814444 - protein, 611 aa, Homo sapiens
QAAAWVAQLPGQRCLSRRVPCVRRGCRPPLPPLPGSQSRAWSRDREAPLDPGRPAQSGRRPTSRSVSHACSWNGGSLDPLEGTPALLRSAERLMRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDHFQATPHHGVYSREEELLRERKRLGVFGITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEGEQSLTNAVDSSR

SEQ ID NO: 814445 - protein, 133 aa, Homo sapiens [sequence omitted]

SEQ ID NO: 814446 - protein, 932 aa, Homo sapiens
QAAAWVAQLPGQRCLSRRVPCVRRGCRPPLPPLPGSQSRAWSRDREAPLDPGRPAQSGRRPTSRSVSHACSWNGGSLDPLEGTPALLRSAERLMRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDHFQATPHHGVYSREEELLRERKRLGVFGITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNDHEPPKVHTMPRTTR

SEQ ID NO: 814447 - protein, 660 aa, Homo sapiens
QAAAWVAQLPGQRCLSRRVPCVRRGCRPPLPPLPGSQSRAWSRDREAPLDPGRPAQSGRRPTSRSVSHACSWNGGSLDPLEGTPALLRSAERLMRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDHFQATPHHGVYSREEELLRERKRLGVFGITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKICVNEETSGVLHGPGHPLSHSSGRMRGGNSLHRFL

SEQ ID NO: 814448 - protein, 70 aa, Homo sapiens
LSWSGRLEEFSVAAIVKIIHTSGGQKSKIKVSSGPRSLWRLQRRTSPGLLQLLVAASIPWLVATTLELLA

SEQ ID NO: 814449 - protein, 500 aa, Homo sapiens
CIERAPAAGTEGAAPALGALGYSCGARGLRALAPGPCWRRRNRGDLGRRRRALGGPRHAELGMRTLLPPALLTCWLLAPVNSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 814450 - protein, 500 aa, Homo sapiens; identical to SEQ ID NO: 814449

SEQ ID NO: 814451 - protein, 500 aa, Homo sapiens; identical to SEQ ID NO: 814449

SEQ ID NO: 814452 - protein, 139 aa, Homo sapiens
CIERAPAAGTEGAAPALGALGYSCGARGLRALAPGPCWRRRNRGDLGRRRRALGGPRHAELGMRTLLPPALLTCWLLAPVNSIHPECRFHLEIQEEETKCAELLRSQTEKHKGHTKGFILIHAGGLKRILDPHTYPLAP

SEQ ID NO: 814453 - protein, 500 aa, Homo sapiens; identical to SEQ ID NO: 814449

SEQ ID NO: 814454 - protein, 500 aa, Homo sapiens; identical to SEQ ID NO: 814449

SEQ ID NO: 814455 - protein, 228 aa, Homo sapiens [sequence omitted]

SEQ ID NO: 814456 - protein, 228 aa, Homo sapiens [sequence omitted]

SEQ ID NO: 814457 - protein, 641 aa, Homo sapiens
CIERAPAAGTEGAAPALGALGYSCGARGLRALAPGPCWRRRNRGDLGRRRRALGGPRHAELGMRTLLPPALLTCWLLAPVSAPATPAPRRLGPGSPLPRRALLPPVFAFLPGAGARAGSGRGSGVARGPELPPGEREALSSGPAGLRDSGWEAACALPRAPPSGVCWKRDRFFLDASTMSSFGAVPGAGSCGRLRGLRVSRGDRGWRWPQMPLGPSLYLLVNSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 814458 - protein, 228 aa, Homo sapiens [sequence omitted]

SEQ ID NO: 814459 - protein, 228 aa, Homo sapiens [sequence omitted]

SEQ ID NO: 814460 - protein, 228 aa, Homo sapiens [sequence omitted]

SEQ ID NO: 814461 - protein, 500 aa, Homo sapiens; identical to SEQ ID NO: 814449

SEQ ID NO: 814462 - protein, 176 aa, Homo sapiens
MVFAVFPISISSKYQILFELCLGSFQGLVVAVLYCFLNSEVSSWPPWNQAQVLTCFLRCCPAWCRSPHTCLSSAGSSYCPGPHSSVSPSENPQRHRQTHSSGGWGCTASCESLGRKPGAELCPAFIPSQGGCLRAAPTAWPRPLTPDPPAPRCGCWRFLCLTCSFHQHGFCKAEPE

SEQ ID NO: 814463 - protein, 117 aa, Homo sapiens
WSLALSPRLECGGTVSAHCNLHLPGSSDSPASASQVAEITEMHHHAQLILYSLVETGFLHVGQAGLELPTSDDPPASASHSAGITGVSERARPTTAFLFKNFPPTFYFEHLLIPQKR

SEQ ID NO: 814464 - protein, 373 aa, Homo sapiens
LLEIAAASRAVWSVRSWPRAAMLRLLASGCARGPGPGVGARPAAGLFHPGRRQSRQASDAPRNQPPSPEFVARPVGVCSMMRLPVQTSPEGLDAAFIGVPLDTGTSNRPGARFGPRRIREESVMLRTVNPSTGALPFQSLMVADLGDVNVNLYNLQDSCRRIQEACEKIVAAGCIPLTLGGDHTITYPILQAMAKKHGPVGLLHVDAHTDTTDKALGEKLYHGAPFRRCVDEGLLDCKRVVQIGIRGSSTTLDPYRYNRSQGFRVVLAEDCWMKSLVPLMGEVRQQMGGKPIYISFDIDALDPAYAPGTGTPEIAGLTPSQALEIIRGCQGLNVMGCDLVEVSPPYDLSGNTALLAANLLFEMLCALPKVTTV

SEQ ID NO: 814465 - protein, 804 aa, Homo sapiens [sequence omitted]

SEQ ID NO: 814466 - protein, 804 aa, Homo sapiens [sequence omitted]

SEQ ID NO: 814467 - protein, 857 aa, Homo sapiens [sequence omitted]

SEQ ID NO: 814468 - protein, 505 aa, Homo sapiens
FPQGSAIPRGSEVSTPLSPLCDNGVLTYHPSLHDYMQNVHGKEIDLLRTTVKVPGKRPPRATSACAPISSPKTNGLSKDMSSLHISPNSGNVTSASGSQMASGISLVSFNSRPDGMHQRSYSVSSADQWSEATVIANSAISSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPIELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 814469 - protein, 705 aa, Homo sapiens
MNYQQQLANSAAIRAEIQRFESVHPNIYSIYELLERVEEPVLQNQIREHVIAIEDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSGNVTSASGSQMASGISLVSFNSRPDGMHQRSYSVSSADQWSEATVIANSAISSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPIELIKVMSSIGNELANSVWEESSQGRTKPSVDSTR

SEQ ID NO: 814470 - protein, 467 aa, Homo sapiens
MNYQQQLANSAAIRAEIQRFESVHPNIYSIYELLERVEEPVLQNQIREHVIAIEDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDTAGMSWYEMAFWDTGKVQKRHEHFTGHLSELNMRFAVLYFNPGGKLVKEDRLRRGQLTSGGGEAQGVRANSPKKRVGSVAA

SEQ ID NO: 814471 - protein, 62 aa, Homo sapiens
HCAVTFWSSVPDAISSANPRVIDDARARKLSNDLKRCTYYETCATYGLNVERVFQDGKCAWL

SEQ ID NO: 814472 - protein, 1120 aa, Homo sapiens
SGLAAGRRRGAEAPRAAASRGCPGHAPHPLSDARAASPAATPRSALGLERPPPQLLTLGSPSPRGTGARLGEPRAWCDGAVRSALRRPQTPATRRLRALQNVAADPAPPGLQQQSPPPPGSSSQLLCLSGTRRRLRVPRIPGSRPPPSSRLRDSSSGLRDPLGSSHCTRAPQTQAPAVVSALPGIQLSRQYPRGQRHRPHPARSEPGRASAVEMNAPLDGLSVSSSSTGSLGSAAGAGGGGGAGLRLLSANVRQLHQALTALLSEAEREQFTHCLNAYHARRNVFDLVRTLRVLLDSPVKRRLLPMLRLVIPRSDQLLFDQYTAEGLYLPATTPYRQPAWGGPDSAGPGEVRLVSLRRAKAHEGLGFSIRGGSEHGVGIYVSLVEPGSLAEKEGLRVGDQILRVNDKSLARVTHAEAVKALKGSKKLVLSVYSAGRIPGGYVTNHIYTWVDPQGRSISPPSGLPQPHGGALRQQEGDRRSTLHLLQGGDEKKVNLVLGDGRSLGLTIRGGAEYGLGIYITGVDPGSEAEGSGLKVGDQILEVNGRSFLNILHDEAVRLLKSSRHLILTVKDVGRLPHARTTVDETKWIASSRIRETMANSAGFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSQLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 814473 - protein, 556 aa, Homo sapiens
MHGSLEALLFLPQVTLSLAHAHLICSNAQLEMCVFPHRFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSQLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 814474 - protein, 723 aa, Homo sapiens
KLLGSRGPRLLPPECRSVACVQALKGSKKLVLSVYSAGRIPGGYVTNHIYTWVDPQGRSISPPSGLPQPHGGALRQQEGDRRSTLHLLQGGDEKKVNLVLGDGRSLGLTIRGGAEYGLGIYITGVDPGSEAEGSGLKVGDQILEVNGRSFLNILHDEAVRLLKSSRHLILTVKDVGRLPHARTTVDETKWIASSRIRETMANSAGFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSQLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 814475 - protein, 127 aa, Homo sapiens
CRLEDPSRHVTTLSTLHLLQGGDEKKVNLVLGDGRSLGLTIRGGAEYGLGIYITGVDPGSEAEGSGLKVGDQILEVNGRSFLNILHDEAVRLLKSSRHLILTVKDVGRLPHARTTVTWREGSSRSPH

SEQ ID NO: 814476 - protein, 558 aa, Homo sapiens
SGLAAGRRRGAEAPRAAASRGCPGHAPHPLSDARAASPAATPRSALGLERPPPQLLTLGSPSPRGTGARLGEPRAWCDGAVRSALRRPQTPATRRLRALQNVAADPAPPGLQQQSPPPPGSSSQLLCLSGTRRRLRVPRIPGSRPPPSSRLRDSSSGLRDPLGSSHCTRAPQTQAPAVVSALPGIQLSRQYPRGQRHRPHPARSEPGRASAVEMNAPLDGLSVSSSSTGSLGSAAGAGGGGGAGLRLLSANVRQLHQALTALLSEAEREQFTHCLNAYHARRNVFDLVRTLRVLLDSPVKRRLLPMLRLVIPRSDQLLFDQYTAEGLYLPATTPYRQPAWGGPDSAGPGEVRLVSLRRAKAHEGLGFSIRGGSEHGVGIYVSLVEPGSLAEKEGLRVGDQILRVNDKSLARVTHAEAVKALKGSKKLVLSVYSAGRIPGGYVTNHIYTWVDPQGRSISPPSGLPQPHGGALRQQEGDRRSTLHLLQGGDEKKVSGVGKGGQPLRHRILPPNPEQQSCLEAARRGWFCPGSVFPQVCTEGWCFFFAFLFDLCSVCYNTG

SEQ ID NO: 814477 - protein, 449 aa, Homo sapiens
SGLAAGRRRGAEAPRAAASRGCPGHAPHPLSDARAASPAATPRSALGLERPPPQLLTLGSPSPRGTGARLGEPRAWCDGAVRSALRRPQTPATRRLRALQNVAADPAPPGLQQQSPPPPGSSSQLLCLSGTRRRLRVPRIPGSRPPPSSRLRDSSSGLRDPLGSSHCTRAPQTQAPAVVSALPGIQLSRQYPRGQRHRPHPARSEPGRASALEMNAPLDGLSVSSSSTGSLGSAAGAGGGGGAGLRLLSANVRQLHQALTALLSEAEREQFTHCLNAYHARRNVFDLVRTLRVLLDSPVKRRLLPMLRLVIPRSDQLLFDQYTAEGLYLPATTPYRQPAWGGPDSAGPGEVRLVSLRRAKAHEGLGFSIRGGSEHGVGIYVSLVEPGSLAEKEGLRVGDQILRVNDKSLARVTHAEAVKVVYPEASHLPSQDLLFSTWKMGPLDQISGP

SEQ ID NO: 814478 - protein, 654 aa, Homo sapiens
CRLEDPSRHVTTLSTLHLLQGGDEKKVNLVLGDGRSLGLTIRGGAEYGLGIYITGVDPGSEAEGSGLKVGDQILEVNGRSFLNILHDEAVRLLKSSRHLILTVKDVGRLPHARTTVDETKWIASSRIRETMANSAGFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSQLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 814479 - protein, 82 aa, Homo sapiens
IELAPPQHLLEPVAPPWIVTIQRGGSAHNCGQLKVGHVILEVNGLTLRGKEHREAARIIAEAFKTKDRDYIDFLVTEFNVML

SEQ ID NO: 814480 - protein, 427 aa, Homo sapiens
CRLEDPSRHVTTLSTLHLLQGGDEKKVNLVLGDGRSLGLTIRGGAEYGLGIYITGVDPGSEAEGSGLKVGDQILEVNGRSFLNILHDEAVRLLKSSRHLILTVKDVGRLPHARTTVDETKWIASSRIRETMANSAGFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPLILRPAFVPHVLQRQIRSLTLSNRIRYQLDSYMY

SEQ ID NO: 814481 - protein, 295 aa, Homo sapiens
SARVAQQFAKSGLAAGRRRGAEAPRAAASRGCPGHAPHPLSDARAASPAATPRSALGLERPPPQLLTLGSPSPRGTGARLGEPRAWCDGAVRSALRRPQTPATRRLRALQNVAADPAPPGLQQQSPPPPGSSSQLLCLSGTRRRLRVPRIPGSRPPPSSRLRDSSSGLRDPLGSSHCTRAPQTQAPAVVSALPGIQLSRQYPRGQRHRPHPARSEPGRASALEMNAPLDGLSVSSSSTGSLGSAAGAGGGGGAGLRLLSANVRQLHQALTALLSEAEREQFTHCLNAYHARRNVF

SEQ ID NO: 814482 - protein, 635 aa, Homo sapiens
MISLFLTTEDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGCRNCIKEGDPPACCFGSYLEIKKQMDKLDPLAHPLLQWIISSNRSHIVKLPLSRQLKFMHTSHQFLLLSSPPAKEARFRTAKKLYGSTFAFHGSHIENWHSILRNGLVNASYTKLQLHGAAYGKGIYLSPISSISFGYSGMGKGQHRMPSKDELVQRYNRMNTIPQTRSIQSRFLQSRNLNCIALCEVITSKDLQKHGNIWVCPVSDHVCTRFFFVYEDGQVGDANINTQDPKIQKEIMRVIGTQVYTN

SEQ ID NO: 814483 - protein, 519 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAGLLCPQHVGLPPPARTSPLVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRQLKFMHTSHQFLLLSSPPAKEARFRTAKKLYGSTFAFHGSHIENWHSILRNGLVNASYTKLQEWEKDSTGCPPRMSWSRDTTG

SEQ ID NO: 814484 - protein, 519 aa, Homo sapiens; identical to SEQ ID NO: 814483

SEQ ID NO: 814485 - protein, 519 aa, Homo sapiens; identical to SEQ ID NO: 814483

SEQ ID NO: 814486 - protein, 519 aa, Homo sapiens; identical to SEQ ID NO: 814483

SEQ ID NO: 814487 - protein, 519 aa, Homo sapiens; identical to SEQ ID NO: 814483

SEQ ID NO: 814488 - protein, 519 aa, Homo sapiens; identical to SEQ ID NO: 814483

SEQ ID NO: 814489 - protein, 519 aa, Homo sapiens; identical to SEQ ID NO: 814483

SEQ ID NO: 814490 - protein, 499 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRQLKFMHTSHQFLLLSSPPAKEARFRTAKKLYGSTFAFHGSHIENWHSILRNGLVNASYTKLQEWEKDSTGCPPRMSWSRDTTG

SEQ ID NO: 814491 - protein, 420 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRWVPH

SEQ ID NO: 814492 - protein, 611 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRQLKFMHTSHQFLLLSSPPAKEARFRTAKKLYGSTFAFHGSHIENWHSILRNGLVNASYTKLQLHGAAYGKGIYLSPISSISFGYSGMGKGQHRMPSKDELVQRYNRMNTIPQTRSIQSRFLQSRNLNCIALCEVITSKDLQKHGNIWVCPVSDHVCTRFFFVYEDGQVGDANINTQDPKIQKEIMRVIGTQVYTN

SEQ ID NO: 814493 - protein, 631 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAGLLCPQHVGLPPPARTSPLVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRQLKFMHTSHQFLLLSSPPAKEARFRTAKKLYGSTFAFHGSHIENWHSILRNGLVNASYTKLQLHGAAYGKGIYLSPISSISFGYSGMGKGQHRMPSKDELVQRYNRMNTIPQTRSIQSRFLQSRNLNCIALCEVITSKDLQKHGNIWVCPVSDHVCTRFFFVYEDGQVGDANINTQDPKIQKEIMRVIGTQVYTN

SEQ ID NO: 814494 - protein, 356 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQVSGHCKNIPTLEYGFLVQIMKYAEQRIPTLNEYCVVCDEQHVFQNGSMLKPAVCTRELCVFSFYTLGVMSGAAEEVATGAEGSYLEIKKQMDKLDPLAHPLLQWIISSNRSHIVKLPLSRWVPH

SEQ ID NO: 814495 - protein, 499 aa, Homo sapiens; identical to SEQ ID NO: 814490

SEQ ID NO: 814496 - protein, 499 aa, Homo sapiens; identical to SEQ ID NO: 814490

SEQ ID NO: 814497 - protein, 499 aa, Homo sapiens; identical to SEQ ID NO: 814490

SEQ ID NO: 814498 - protein, 109 aa, Homo sapiens
MGKGQHRMPSKDELVQRYNRMNTIPQTRSIQSRFLQSRNLNCIALCEVITSKDLQKHGNIWVCPVSDHVCTRFFFVYEDGQVGDANINTQDPKIQKEIMRVIGTQVYTN

SEQ ID NO: 814499 - protein, 499 aa, Homo sapiens; identical to SEQ ID NO: 814490

SEQ ID NO: 814500 - protein, 109 aa, Homo sapiens; identical to SEQ ID NO: 814498

SEQ ID NO: 814501 - protein, 499 aa, Homo sapiens; identical to SEQ ID NO: 814490

SEQ ID NO: 814502 - protein, 380 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAGLLCPQHVGLPPPARTSPLVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKLHGRA

SEQ ID NO: 814503 - protein, 454 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRQLKFMHTSHQFLLLSSPPAKEARFRTAKKLYGSTFAFQ

SEQ ID NO: 814504 - protein, 501 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQVSGHCKNIPTLEYGFLVQIMKYAEQRIPTLNEYCVVCDEQHVFQNGSMLKPAVCTRELCVFSFYTLGVMSGAAEEVATGAEVVDLLVAMCRAALESPRKSIIFEPYPSVVDPTDPKTLAFNPKKKNYERLQKALDSVMSIREMTQGSYLEIKKQMDKLDPLAHPLLQWIISSNRSHIVKLPLSRWVPNLACWWSSTCIRRSTLSIRDTTAVIRAHGKMAASSLSHRLPFAIEAQQRKVCQLQILSPCLIVISISVLQDSDIFHKCTVSR

SEQ ID NO: 814505 - protein, 232 aa, Homo sapiens
IFKSPRCSTSIVEPENPAVSKASGLPSVSTCRPQPPARGLPPGLQATWVALPACSSQPLGALNASILLWKAPRTPPESLFLLHCLPYPRRRRHPPLRTLSRLATAAQASQGWRRLLRRAQEQAVRLLVRSGPRAIVSPRELRRVAERARDGTTRRGVRDLARQARPPPLGLPLRPRGASRAARPVGCGRARPGVAVSTRQAGLCGRHHGHRAVRPGHGKGAGLAPSPQGWTK

SEQ ID NO: 814506 - protein, 676 aa, Homo sapiens
PVRLDRLSEAAKVNTDAMRSAQEEITEYRRQLQARTTELEALKSTKDSLERQRSELEDRHQADIASYQEAIQQLDAELRNTKWEMAAQLREYQDLLNVKMALDIEIAAYRKLLEGEECRIGFGPIPFSLPEGLPKIPSVSTHIKVKSEEKIKVVEKSEKETVIVEEQTEETQVTEEVTEEEEKEAKEEEGKEEEGGEEEEAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKEEAKSPAEVKSPEKAKSPTKEEAKSPEKSPLRRPSPQLKEEAKSPEKAKSPVKEEAKTPEKAKSPVKEEAKSPEKAKSPEKAKTLDVKSPEAKTPAKEEARSPADKFPEKAKSPVKEEVKSPEKAKSPLKEDAKAPEKEIPKKEEVKSPVKEEEKPQEVKVKEPPKKAEEEKAPATPKTEEKKDSKKEEAPKKEAPKPKVEEKKEPAVEKPKESKVEAKKEEAEDKKKVPTPEKEAPAKVEVKEDAKPKEKTEVAKKEPDDAKAKEPSKPAEKKEAAPEKKDTKEEKAKKPEEKPKTEAKAKEDDKTLSKEPSKPKAEKAEKSSSTDQKDSKPPEKATEDKAAKGK

SEQ ID NO: 814507 - protein, 615 aa, Homo sapiens
CVTSPSQEAIQQLDAELRNTKWEMAAQLREYQDLLNVKMALDIEIAAYRKLLEGEECRIGFGPIPFSLPEGLPKIPSVSTHIKVKSEEKIKVVEKSEKETVIVEEQTEETQVTEEVTEEEEKEAKEEEGKEEEGGEEEEAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKEEAKSPAEVKSPEKAKSPTKEEAKSPEKSPLRRPSPQWKEEAKSPEKAKSPVKEEAKTPEKAKSPVKEEAKSPEKAKSPEKAKTLDVKSPEAKTPAKEEARSPADKFPEKAKSPVKEEVKSPEKAKSPLKEDAKAPEKEIPKKEEVKSPVKEEEKPQEVKVKEPPKKAEEEKAPATPKTEEKKDSKKEEAPKKEAPKPKVEEKKEPAVEKPKESKVEAKKEEAEDKKKVPTPEKEAPAKVEVKEDAKPKEKTEVAKKEPDDAKAKEPSKPAEKKEAAPEKKDTKEEKAKKPEEKPKTEAKAKEDDKTLSKEPSKPKAEKAEKSSSTDQKDSKPPEKATEDKAAKGK

SEQ ID NO: 814508 - protein, 488 aa, Homo sapiens
GRLLLLNSRPVDAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKEEAKSPAEVKSPEKAKSPTKEEAKSPEKSPLRRPSPQWKEEAKSPEKAKSPVKEEAKTPEKAKSPVKEEAKSPEKAKSPEKAKTLDVKSPEAKTPAKEEARSPADKFPEKAKSPVKEEVKSPEKAKSPLKEDAKAPEKEIPKKEEVKSPVKEEEKPQEVKVKEPPKKAEEEKAPATPKTEEKKDSKKEEAPKKEAPKPKVEEKKEPAVEKPKESKVEAKKEEAEDKKKVPTPEKEAPAKVEVKEDAKPKEKTEVAKKEPDDAKAKEPSKPAEKKEAAPEKKDTKEEKAKKPEEKPKTEAKAKEDDKTLSKEPSKPKAEKAEKSSSTDQKDSKPPEKATEDKAAKGK

SEQ ID NO: 814509 - protein, 200 aa, Homo sapiens
GRLLLLNSRPVDVKVKEPPKKAEEEKAPATPKTEEKKDSKKEEAPKKEAPKPKVEEKKEPAVEKPKESKVEAKKEEAEDKKKVPTPEKEAPAKVEVKEDAKPKEKTEVAKKEPDDAKAKEPSKPAEKKEAAPEKKDTKEEKAKKPEEKPKTEAKAKEDDKTLSKEPSKPKAEKAEKSSSTDQKDSKPPEKATEDKAAKGK

SEQ ID NO: 814510 - protein, 621 aa, Homo sapiens
PVRLDRLSEAAKVNTDAMRSAQEEITEYRRQLQARTTELEALKSTKDSLERQRSELEDRHQADIASYQEAIQQLDAELRNTKWEMAAQLREYQDLLNVKMALDIEIAAYRKLLEGEECRIGFGPIPFSLPEGLPKIPSVSTHIKVKSEEKIKVVEKSEKETVIVEEQTEETQVTEEVTEEEEKEAKEEEGKEEEGGEEEEAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKEEAKSPAEVKSPEKAKSPTKEEAKSPEKSPLRRPSPQLKEEAKSPEKAKSPVKEEAKTPEKAKSPVKEEAKSPEKAKSPEKAKTLDVKSPEAKTPAKEEARSPADKFPEKAKSPVKEEVKSPEKAKSPLKEDAKAPEKEIPKKEEVKSPVKEEEKPQEVKVKEPPKKAEEEKAPATPKTEEKKDSKKEEAPKKEAPKPKVEEKKEPAVEKPKESKVEAKKEEAEDKKKVPTPEKEAPAKVEVKEDAKPKEKTEVAKKEPDDAKAKEPSKPAETIPAAQEVDAAANLVVVGG

SEQ ID NO: 814511 - protein, 348 aa, Homo sapiens
PVRLDRLSEAAKVNTDAMRSAQEEITEYRRQLQARTTELEALKSTKDSLERQRSELEDRHQADIASYQEAIQQLDAELRNTKWEMAAQLREYQDLLNVKMALDIEIAAYRKLLEGEECRIGFGPIPFSLPEGLPKIPSVSTHIKVKSEEKIKVVEKSEKETVIVEEQTEETQVTEEVTEEEEKEAKEEEGKEEEGGEEEEAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKAKSPTKEEAKSPEKSQVP

SEQ ID NO: 814512 - protein, 375 aa, Homo sapiens
PVRLDRLSEAAKVNTDAMRSAQEEITEYRRQLQARTTELEALKSTKDSLERQRSELEDRHQADIASYQEAIQQLDAELRNTKWEMAAQLREYQDLLNVKMALDIEIAAYRKLLEGEECRIGFGPIPFSLPEGLPKIPSVSTHIKVKSEEKIKVVEKSEKETVIVEEQTEETQVTEEVTEEEEKEAKEEEGKEEEGGEEEEAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKEEAKSPAEVKSPEKAKSPTKEEAKSPEKIITLTQPTRYENDYSLE

SEQ ID NO: 814513 - protein, 145 aa, Homo sapiens
MSSSGTICAQQSFNMEQANYTIQSLKDTKTTVDAMKLGVKEMKKAYKQVKIDQIEDLQDQLEDMMEDANEIQEALSRSYGTPELDEDDLEAELDALGDELLADEDSSYLDEAASAPAIPEGVPTDTKNKDGVLVDEFGLPQIPAS

SEQ ID NO: 814514 - protein, 158 aa, Homo sapiens
MSSSGTICAQQSFNMEQANYTIQSLKDTKTTVDAMKLGVKEMKKAYKQVKIDQIEDLQDQLEDMMEDANEIQEALSRSYGTPELDEDDLEAELDALGDELLADEDSSYLDEAASAPAIPEGVPTDTKNKGWGLVDELGCQDPGHRLVIQAFCEHTFLG

SEQ ID NO: 814515 - protein, 134 aa, Homo sapiens
MSSSGTICAQQSFNMEQANYTIQSLKDTKTTVDAMKLGVKEMKKAYKQVKIDQIEDLQDQLEDMMEDANEIQEALSRSYGTPELDEDDLEAELDALGDELLADEDSSYLDEAASAPAIPEGVPTDTKNKMESGG

SEQ ID NO: 814516 - protein, 123 aa, Homo sapiens
MNRLFGKAKPKAPPPSLTDCIGTVDSRAESIDKKISRLDAELVKYKDQIKKMREGPAKGKVGSNCCTRCWQSLVLAPIEIGPEFGWAQWLMHVIPALWEAEAGGSRGQAFETSLANIAKPCLY

SEQ ID NO: 814517 - protein, 145 aa, Homo sapiens; identical to SEQ ID NO: 814513

SEQ ID NO: 814518 - protein, 145 aa, Homo sapiens; identical to SEQ ID NO: 814513

SEQ ID NO: 814519 - protein, 145 aa, Homo sapiens; identical to SEQ ID NO: 814513

SEQ ID NO: 814520 - protein, 229 aa, Homo sapiens
MNRLFGKAKPKAPPPSLTDCIGTVDSRAESIDKKISRLDAELVKYKDQIKKMREGPAKEYGQAESLASFKAKEDVSFLCFCIRGMSSSGTICAQQSFNMEQANYTIQSLKDTKTTVDAMKLGVKEMKKAYKQVKIDQIEDLQDQLEDMMEDANEIQEALSRSYGTPELDEDDLEAELDALGDELLADEDSSYLDEAASAPAIPEGVPTDTKNKDGVLVDEFGLPQIPAS

SEQ ID NO: 814521 - protein, 145 aa, Homo sapiens; identical to SEQ ID NO: 814513

SEQ ID NO: 814522 - protein, 145 aa, Homo sapiens; identical to SEQ ID NO: 814513

SEQ ID NO: 814523 - protein, 204 aa, Homo sapiens
MNRLFGKAKPKAPPPSLTDCIGTVDSRAESIDKKISRLDAELVKYKDQIKKMREGPAKEYGQAESLASFKAKEDEQANYTIQSLKDTKTTVDAMKLGVKEMKKAYKQVKIDQIEDLQDQLEDMMEDANEIQEALSRSYGTPELDEDDLEAELDALGDELLADEDSSYLDEAASAPAIPEGVPTDTKNKDGVLVDEFGLPQIPAS

SEQ ID NO: 814524 - protein, 242 aa, Homo sapiens
MNRLFGKAKPKAPPPSLTDCIGTLGDSSSRISIDRERIPSYFGMPEVLERYHGLMNSTNEGRMQRAHSIIQLLHQVMKIASCRDSHRRQYSRECLESRQPWTNSGPNKFNSHEQANYTIQSLKDTKTTVDAMKLGVKEMKKAYKQVKIDQIEDLQDQLEDMMEDANEIQEALSRSYGTPELDEDDLEAELDALGDELLADEDSSYLDEAASAPAIPEGVPTDTKNKDGVLVDEFGLPQIPAS

SEQ ID NO: 814525 - protein, 171 aa, Homo sapiens
MSSSGTICAQQSFNMEQANYTIQSLKDTKTTVDAMKLGVKEMKKAYKQVKIDQIEDLQDQLEDMMEDANEIQEALSRSYGTPELDEDDLEAEDCGKLFFFKRGKKGQEDLGMANYKGELDALGDELLADEDSSYLDEAASAPAIPEGVPTDTKNKDGVLVDEFGLPQIPAS

SEQ ID NO: 814526 - protein, 73 aa, Homo sapiens
LPTPRPLQALSESTKSFCSPSPEDPAENPEKESGNARRHIALAHGGAGSRGGSDSASVSGFALVFGFLRGCSR

SEQ ID NO: 814527 - protein, 73 aa, Homo sapiens; identical to SEQ ID NO: 814526

SEQ ID NO: 814528 - protein, 73 aa, Homo sapiens; identical to SEQ ID NO: 814526

SEQ ID NO: 814529 - protein, 73 aa, Homo sapiens; identical to SEQ ID NO: 814526

SEQ ID NO: 814530 - protein, 118 aa, Homo sapiens
MSSSGTICAQQSFNMEQANYTIQSLKDTKTTVDAMKLGVKEMKKAYKQVKIDQIEDLQDQLEDMMEDANEIQEALSRSYGTPELDEDDLEAEVSYEKSNVYLVLESKSNSCLGPFLKC

SEQ ID NO: 814531 - protein, 73 aa, Homo sapiens; identical to SEQ ID NO: 814526

SEQ ID NO: 814532 - protein, 158 aa, Homo sapiens; identical to SEQ ID NO: 814514

SEQ ID NO: 814533 - protein, 206 aa, Homo sapiens
MGILSRNLGHAAFWPDDMWIEVLADRSVALLVVGFVPRGVVDEADSLPLVCEPVGTVAERKVGNMSLSGKSARLWLAAELSNAFQGVLESRVRSLSTCGGPWEVGNNGQSKVFCRVKLVLVETRIGGPKETNIEHGASPRVGPRDVFATSWNNGGPSVLRPLARSGRRKPEGDRRMPRKGGKLGGRGFVAVWGLGRNVRRSLRFEA

SEQ ID NO: 814534 - protein, 118 aa, Homo sapiens; identical to SEQ ID NO: 814530

SEQ ID NO: 814535 - protein, 106 aa, Homo sapiens
MNRLFGKAKPKAPPPSLTDCIGTVDSRAESIDKKISRLDAELVKYKDQIKKMREGPAKEYGQAESLASFKAKEDFLSSASAYVVCVHKLFRRNEIVVCICRFSFST

SEQ ID NO: 814536 - protein, 116 aa, Homo sapiens
LWWPLKVSGADCPEGGKGWSLGQPEAPDMRAGTPKCTRSPELVFCDFHSPWSLFPFVLKARASREGKPEIGSSGPGQTLCAAANRCSLRLSGPPPDTCGPSLSWLPVWSWRDSGSA

SEQ ID NO: 814537 - protein, 347 aa, Homo sapiens
MARFWVCVAGAGFFLAFLVLHSRFCGSPVLRNFTFAVSWRTEKILYRLDVGWPKHPEYFTGTTFCVAVDSLNGLVYIGQRGDNIPKILVFTEDGYFLRAWNYTVDTPHGIFAASTLYEQSVWITDVGSGFFGHTVKKYSSFGDLVQVLGTPGKKGTSLNPLQFDNPAELYVEDTGDIYIVDGDGGLNNRLIKLSQDFMILWLHGENGTGPAKFNIPHSVTLDSAGRVWVADRGNKRIQVFDKDTGEWLGAWNNCFTEEGPSSVRFTPDGKYLIVAQLNLSRLSVVAAPPVGSIGECSVISTIQLADQVLPHLLEVDRKTGAVYVAEIGAKQVQKYVPLNSYVPSFGS

SEQ ID NO: 814538 - protein, 150 aa, Homo sapiens
MILWLHGENGTGPAKFNIPHSVTLDSAGRVWVADRGNKRIQVFDKDTGEWLGAWNNCFTEEGPSSVRFTPDGKYLIVAQLNLSRLSVVAAPPVGSIGECSVISTIQLADQVLPHLLEVDRKTGAVYVAEIGAKQVQKYVPLNSYVPSFGS

SEQ ID NO: 814539 - protein, 116 aa, Homo sapiens; identical to SEQ ID NO: 814536

SEQ ID NO: 814540 - protein, 116 aa, Homo sapiens; identical to SEQ ID NO: 814536

SEQ ID NO: 814541 - protein, 260 aa, Homo sapiens
MARFWVCVAGAGFFLAFLVLHSRFCGSPVLRNFTFAVSWRTEKILYRLDVGWPKHPEYFTGTTFCVAVDSLNGLVYIGQRGDNIPKILVFTEDGYFLRAWNYTVDTPHGIFAASTLYEQSVWITDVGSGFFGHTVKKYSSFGDLVQVLGTPGKKGTSLNPLQFDNPAELYVEDTGDIYIVDGDGGLNNRLIKLSQDFMILWLHGENGTGPAKFNIPHSVTLDSAGRVQIQRHCVWDFVSEYVCVCVCVCVCVCVCLGMYI

SEQ ID NO: 814542 - protein, 500 aa, Homo sapiens
LKFLAVLLAAGMLAFLGAVICIIASVPLAASPARALPGGADNASVASGAAASPGPQRSLSALHGAGGSAGPPALPGAPAASAHPLPPGPLFSRFLCTPLAAACPSGAQQGDAAGAAPGEREELLLLQSTAEQLRQTALQQEARIRADQDTIRELTGKLGRCESGLPRGLQGAGPRRDTMADGPWDSPALILELEDAVRALRDRIDRLEQELPARVNLSAAPAPVSAVPTGLHSKMDQLEGQLLAQVLALEKERVALSHSSRRQRQEVEKELDVLQGRVAELEHGSSAYSPPDAFKISIPIRNNYMYARVRKALPELYAFTACMWLRSRSSGTGQGTPFSYSVPGQANEIVLLEAGHEPMELLINDKVAQLPLSLKDNGWHHICIAWTTRDGLWSAYQDGELQGSGENLAAWHPIKPHGILILGQEQDTLGGRFDATQAFVGDIAQFNLWDHALTPAQVLGIANCTAPLLGNVLPWEDKLVEAFGGATKAAFDVCKGRAKA

SEQ ID NO: 814543 - protein, 196 aa, Homo sapiens
MYARVRKALPELYAFTACMWLRSRSSGTGQGTPFSYSVPGQANEIVLLEAGHEPMELLINDKVAQLPLSLKDNGWHHICIAWTTRDGLWSAYQDGELQGSGENLAAWHPIKPHGILILGQEQDTLGGRFDATQAFVGDIAQFNLWDHALTPAQVLGIANCTAPLLGNVLPWEDKLVEAFGGATKAAFDVCKGRAKA

SEQ ID NO: 814544 - protein, 500 aa, Homo sapiens; identical to SEQ ID NO: 814542

SEQ ID NO: 814545 - protein, 102 aa, Homo sapiens [sequence omitted]

SEQ ID NO: 814546 - protein, 158 aa, Homo sapiens
APSLMDESWFVTPPACFTAEGPGLGPARLQSSPLEDLLIEHPSMSVYVTGSTIVLEPGSPSPLPDAALPDGDLSEGELTPARREPRAARHAAPLPARAALLEKAGQVRRLQRARQRAERHALSAKAVQRQNRARESRPRRSKNQSSFIYQPCQRQFNY

SEQ ID NO: 814547 - protein, 158 aa, Homo sapiens; identical to SEQ ID NO: 814546

SEQ ID NO: 814548 - protein, 158 aa, Homo sapiens; identical to SEQ ID NO: 814546

SEQ ID NO: 814549 - protein, 158 aa, Homo sapiens; identical to SEQ ID NO: 814546

SEQ ID NO: 814550 - protein, 158 aa, Homo sapiens; identical to SEQ ID NO: 814546

SEQ ID NO: 814551 - protein, 158 aa, Homo sapiens; identical to SEQ ID NO: 814546

SEQ ID NO: 814552 - protein, 3063 aa, Homo sapiens [sequence omitted]

SEQ ID NO: 814553 - protein, 153 aa, Homo sapiens
MKGTRLMVCFSVLEVPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVG

SEQ ID NO: 814554 - protein, 3063 aa, Homo sapiens [sequence omitted]

SEQ ID NO: 814555 - protein, 3063 aa, Homo sapiens [sequence omitted]

SEQ ID NO: 814556 - protein, 1141 aa, Homo sapiens
MRSRLPPALAALGAALLLSSIEAEGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTSKFLRNLESFHKALE

SEQ ID NO: 814557 - protein, 788 aa, Homo sapiens
MCTWCVFIIIIFKFSAVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQSYPGSG

SEQ ID NO: 814558 - protein, 788 aa, Homo sapiens
MCTWCVFIIIIFKFVAVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQSYPGSG

SEQ ID NO: 814559 - protein, 550 aa, Homo sapiens
VYTEGDGGRTSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTSKFLRNLESFHKALE

SEQ ID NO: 814560 - protein, 675 aa, Homo sapiens
AVVADLDVLHLDGVLGVGLRIMELANIQQWTAVTGEGKWPRPLEPLAAVCAEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQSYPGSG

SEQ ID NO: 814561 - protein, 220 aa, Homo sapiens
VYTEGDGGRTSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTHPGVPFLIVENLVSAGSLAPSTQSVDIFAFALEMLAKYFVNKSCKERTCRVPLVSTAGSLSETLRLSS

SEQ ID NO: 814562 - protein, 2305 aa, Homo sapiens
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTSKFLRNLESFHKALE

SEQ ID NO: 814563 - protein, 2305 aa, Homo sapiens; identical to SEQ ID NO: 814562

SEQ ID NO: 814564 - protein, 1755 aa, Homo sapiens
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQGKNLI

SEQ ID NO: 814565 - protein, 126 aa, Homo sapiens
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGFFSTGFVEPRA

SEQ ID NO: 814566 - protein, 448 aa, Homo sapiens
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPRVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 814567 - protein, 111 aa, Homo sapiens
LWPGSGRPEEADPAVQSSTASAGPPSCPERLPPVPSALTGWLLVHQSPCSSHTGLFLSSNEPNASRPPPGPSPLFPLPGPPLPSLGRRRGRPRHSPQTAARPSCAVHHSCI

SEQ ID NO: 814568 - protein, 185 aa, Homo sapiens
EVAPLEPMPGWEWGRSPDIQTAPHSRPYTPGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATGSWGGEVEKGG

SEQ ID NO: 814569 - protein, 412 aa, Homo sapiens [sequence omitted]

SEQ ID NO: 814570 - protein, 299 aa, Homo sapiens [sequence omitted]

SEQ ID NO: 814571 - protein, 299 aa, Homo sapiens [sequence omitted]

SEQ ID NO: 814572 - protein, 70 aa, Homo sapiens
FQVQKTAGFCQHLHKHKAYLTPKVRVPQLWACPASHGSGMPCYPQEGSQLPLSQAAVYLSTCKDSKKKAE

SEQ ID NO: 814573 - protein, 86 aa, Homo sapiens
ESKQCPESKQCPESKQCPESKQCPESKQCPESKQCLSSAPNPSNLSPLSGWNAFFFFFHLYKDNFSFFFFFETESHLFRPGCSAVA

SEQ ID NO: 814574 - protein, 448 aa, Homo sapiens; identical to SEQ ID NO: 814566

SEQ ID NO: 814575 - protein, 448 aa, Homo sapiens; identical to SEQ ID NO: 814566

SEQ ID NO: 814576 - protein, 299 aa, Homo sapiens [sequence omitted]

SEQ ID NO: 814577 - protein, 448 aa, Homo sapiens; identical to SEQ ID NO: 814566

SEQ ID NO: 814578 - protein, 448 aa, Homo sapiens; identical to SEQ ID NO: 814566

SEQ ID NO: 814579 - protein, 448 aa, Homo sapiens; identical to SEQ ID NO: 814566

SEQ ID NO: 814580 - protein, 448 aa, Homo sapiens; identical to SEQ ID NO: 814566

SEQ ID NO: 814581 - protein, 412 aa, Homo sapiens [sequence omitted]

SEQ ID NO: 814582 - protein, 412 aa, Homo sapiens [sequence omitted]

SEQ ID NO: 814583 - protein, 412 aa, Homo sapiens [sequence omitted]

SEQ ID NO: 814584 - protein, 412 aa, Homo sapiens [sequence omitted]

SEQ ID NO: 814585 - protein, 299 aa, Homo sapiens [sequence omitted]

SEQ ID NO: 814586 - protein, 167 aa, Homo sapiens [sequence omitted]

SEQ ID NO: 814587 - protein, 627 aa, Homo sapiens
MNLIFHKDILFGIPANKVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKVEQCRFCMVHLKTCTNTGQSK

SEQ ID NO: 814588 - protein, 977 aa, Homo sapiens
MKGLSGSRSHHHGVTCDSACDSLSHHSDRKPYLLSPVEHHPADHPYYTQRNSFQAECVGPFSDPLASSTFPRRHYTSQQELKDECALVPRTLATKANRIPANLLDQFERQLPLSRDGYHTLQYKRTAVEHRSDSPGRIRHLVHSVQKLFTKSHSLEGPSKGSVNGGKASPDEAQAARYGKRSKSKERRAEPKARPSTSPGWWSSDDNLDGDMCIYHAPSGVMTMGRCPDRSASQYFLEAYNTISEQAVKASRSNNDVKCSTCANLPVSLDTPLLKKSAWSSTLTVSRAREVYQKASVNMDQAMVKSESCQQERSCQYLQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 814589 - protein, 675 aa, Homo sapiens
MNLIFHKDILFGIPANKVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKERRAPPPVPKKPAKGPAPLIRERSLESSQRQEARKRLMAAKRAASVRQNSATESAESIEIYIPEAQTRL

SEQ ID NO: 814590 - protein, 635 aa, Homo sapiens
MIDLFKAEWVSSVCVQVSRNGRTDQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVSSCITTYKKTPPPVPPRTTTKPFISITAQSSTESAQDAYMDGQGQRGDIISQSGLSNSTESLDSMKALTAAIEAANAQIHGPASQHMGNNTATVTTTTTIATVTTEDRKKDHFKKNRCLSIGIQVDDAEEPDKTGENKAPSKFQSVGVQVEEEKCFRRFTRSNSVTTAVQADLDFHDNLENSLESIEDNSCPGPMARQFSRDASTSTVSIQGSGNHYHACAADDDFDTDFDPSILPPPDPWIDSITEDPLEAVQRSVCHRDGHWFLKLLQAERDRMEGWCQQMEREERENNLPEDILGKIRTAVGSAQLLMAQKFYQFRELCEENLNPNAHPRPTSQDLAGFWDMLQLSIENISMKFDELHQLKANNWKQMDPLDKKVEQCRFCMVHLKTCTNTGQSK

SEQ ID NO: 814591 - protein, 635 aa, Homo sapiens; identical to SEQ ID NO: 814590

SEQ ID NO: 814592 - protein, 276 aa, Homo sapiens
MIDLFKAEWVSSVCVQVSRNGRTDQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTVELETSRTSTLAGSDERKKSKIYDTTYSFCEATYPCLLLH

SEQ ID NO: 814593 - protein, 265 aa, Homo sapiens
MIDLFKAEWVSSVCVQVSRNGRTDQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTGPNHNRDDRWRCPARLSCHLLAYHHFANR

SEQ ID NO: 814594 - protein, 249 aa, Homo sapiens
MIDLFKAEWVSSVCVQVSRNGRTDQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTGSLDKKLESWALG

SEQ ID NO: 814595 - protein, 237 aa, Homo sapiens
MIDLFKAEWVSSVCVQVSRNGRTDQVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDPAGLLTSPKFRSRNESYMRAMSTISQVSEMEVNGQFESVCESVFSELESQAVEALDLPMPGCFRMRSHSYVRAIEKGCSQDDECVSLRSSSPPRTTTTVRTIQSSTD

SEQ ID NO: 814596 - protein, 513 aa, Homo sapiens
LLPHRPSPFVPYPGPVLSQVPDVQFQMPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVAVNYSQPISEASRGSEAINAPGDNPAKVQNHCQEPYYQAAAAGALTCATPGTWKDRQDGEEVLQCMPVCGRPVTPIAQNQTTLGSSRAKLGNFPWQAFTSIHGRGGGALLGDRWILTAAHTVYPKDSVSLRKNQSVNVFLGHTAIDEMLKLGNHPVHRVVVHPDYRQNESHNFSGDIALLELQHSIPLGPNVLPVCLPDNETLYRSGLLGYVSGFGMEMGWLTTELKYSRLPVAPREACNAWLQKRQRPEVFSDNMFCVGDETQRHSVCQGDSGSVYVVWDNHAHHWVATGIVSWGIGCGEGYDFYTKVLSYVDWIKGVMNGKN

SEQ ID NO: 814597 - protein, 316 aa, Homo sapiens
GGGVPPPPLPRGGSQKEPKKGWGGGAQNPFSKPPLGWPKTPPGTWKDRQDGEEVLQCMPVCGRPVTPIAQNQTTLGSSRAKLGNFPWQAFTSIHGRGGGALLGDRWILTAAHTVYPKDSVSLRKNQSVNVFLGHTAIDEMLKLGNHPVHRVVVHPDYRQNESHNFSGDIALLELQHSIPLGPNVLPVCLPDNETLYRSGLLGYVSGFGMEMGWLTTELKYSRLPVAPREACNAWLQKRQRPEVFSDNMFCVGDETQRHSVCQGDSGSVYVVWDNHAHHWVATGIVSWGIGCGEGYDFYTKVLSYVDWIKGVMNGKN

SEQ ID NO: 814598 - protein, 455 aa, Homo sapiens
LLPHRPSPFVPYPGPVLSQVPDVQFQMPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVAVNYSQPISEASRGSEAINAPGDNPAKVQNHCQEPYYQAAAAGALTCATPGTWKDRQDGEEVLQCMPVCGRPVTPIAQNQTTLGSSRAKLGNFPWQAFTSIHGRGGGALLGDRWILTAAHTVYPKDSVSLRKNQSVNVFLGHTAIDEMLKLGNHPVHRVVVHPDYRQNESHNFSGDIALLELQHSIPLGPNVLPVCLPDNETLYRSGLLGYVSGFGMEMGWLTTELKYSRLPVAPREACNAWLQKRQRPEVFSDNMFCVGDERRIT

SEQ ID NO: 814599 - protein, 295 aa, Homo sapiens
LLPHRPSPFVPYPGPVLSQVPDVQFQMPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVAVNYSQPISEASRGSEAINAPGDNPAKVQNHCQEPYYQAAAAGALTCATPGTWKDRQDGEEVLQCMPGTTKLSSTAAAPSYISPAIHEGSSPPFLRSTLLNESIAF

SEQ ID NO: 814600 - protein, 287 aa, Homo sapiens
LLPHRPSPFVPYPGPVLSQVPDVQFQMPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVAVNYSQPISEASRGSEAINAPGDNPAKVQNHCQEPYYQAAAAGALTCATPGTWKDRQDGEEVLQCMPAAAPSYISPAIHEGSSPPFLRSTLLNESIAF

SEQ ID NO: 814601 - protein, 164 aa, Homo sapiens
LLPHRPSPFVPYPGPVLSQVPDVQFQMPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTVSWGWGGSRQDCGQGDSRGCGKWRCPESPIWRRDEFSM

SEQ ID NO: 814602 - protein, 164 aa, Homo sapiens; identical to SEQ ID NO: 814601

SEQ ID NO: 814603 - protein, 108 aa, Homo sapiens
STSEKQVFNQCVSDAAADCHPYPASLPVCGRPVTPIAQNQTTLGSSRAKLGNFPWQAFTSIHGRGGGALLGDRWILTAAHTVYPKDSVSLRKNQSVNVFLGHTAIDEM

SEQ ID NO: 814604 - protein, 594 aa, Homo sapiens
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVVDILLNYVRKTFDRSTKVLDFHHPHQLLEGMEGFNLELSDHPESLEQILVDCRDTLKYGVRTGHPRFFNQLSTGLDIIGLAGEWLTSTANTNMFTYEIAPVFVLMEQITLKKMREIVGWSSKDGDGIFSPGGAISNMYSIMAARYKYFPEVKTKGMAAVPKLVLFTSEQSHYSIKKAGAALGFGTDNVILIKCNERGKIIPADFEAKILEAKQKGYVPFYVNATAGTTVYGAFDPIQEIADICEKYNLWLHVDAAWGGGLLMSRKHRHKLNGIERANSVTWNPHKMMGVLLQCSAILVKEKGILQGCNQMCAGYLFQPDKQYDVSYDTGDKAIQCGRHVDIFKFWLMWKAKGTVGFENQINKCLELAEYLYAKIKNREEFEMVFNGEPEHTNVCFWYIPQSLRGVPDSPQRREKLHKVAPKIKALMMESGTTMVGYQPQGDKANFFRMVISNPAATQSDIDFLIEEIERLGQDL

SEQ ID NO: 814605 - protein, 224 aa, Homo sapiens
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVVDILLNYVRKTFDRSTKVLDFHHPHQLLEGMEGFNLELSDHPESLEQILVDCRDTLKYGVRTGHPRFFNQLSTGLDIIGLAGEWLTSTANTNMPSDMRECWLLR

SEQ ID NO: 814606 - protein, 594 aa, Homo sapiens; identical to SEQ ID NO: 814604

SEQ ID NO: 814607 - protein, 254 aa, Homo sapiens
SGLREPQRQRRVLPAESQAGEAERRRGRQGARRSHPPSGPRQLLTRHAMARGKAKANSVTWNPHKMMGVLLQCSAILVKEKGILQGCNQMCAGYLFQPDKQYDVSYDTGDKAIQCGRHVDIFKFWLMWKAKGTVGFENQINKCLELAEYLYAKIKNREEFEMVFNGEPEHTNVCFWYIPQSLRGVPDSPQRREKLHKVAPKIKALMMESGTTMVGYQPQGDKANFFRMVISNPAATQSDIDFLIEEIERLGQDL

SEQ ID NO: 814608 - protein, 524 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVADLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 814609 - protein, 530 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 814610 - protein, 77 aa, Homo sapiens
QSTYCAYTIETALQYKRQVYVDTELVDAVAGVDPELPKPPSCSPAWASLIPLFFLDSLGPSRPWNPIFGLGGSAAWA

SEQ ID NO: 814611 - protein, 77 aa, Homo sapiens; identical to SEQ ID NO: 814610

SEQ ID NO: 814612 - protein, 77 aa, Homo sapiens; identical to SEQ ID NO: 814610

SEQ ID NO: 814613 - protein, 77 aa, Homo sapiens; identical to SEQ ID NO: 814610

SEQ ID NO: 814614 - protein, 373 aa, Homo sapiens
MQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 814615 - protein, 77 aa, Homo sapiens; identical to SEQ ID NO: 814610

SEQ ID NO: 814616 - protein, 77 aa, Homo sapiens; identical to SEQ ID NO: 814610

SEQ ID NO: 814617 - protein, 373 aa, Homo sapiens; identical to SEQ ID NO: 814614

SEQ ID NO: 814618 - protein, 373 aa, Homo sapiens; identical to SEQ ID NO: 814614

SEQ ID NO: 814619 - protein, 373 aa, Homo sapiens; identical to SEQ ID NO: 814614

SEQ ID NO: 814620 - protein, 77 aa, Homo sapiens; identical to SEQ ID NO: 814610

SEQ ID NO: 814621 - protein, 373 aa, Homo sapiens; identical to SEQ ID NO: 814614

SEQ ID NO: 814622 - protein, 512 aa, Homo sapiens
MADDIDIEAMLEAPYKKDENKLSSANGHEERSKNKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 814623 - protein, 77 aa, Homo sapiens; identical to SEQ ID NO: 814610

SEQ ID NO: 814624 - protein, 77 aa, Homo sapiens; identical to SEQ ID NO: 814610

SEQ ID NO: 814625 - protein, 77 aa, Homo sapiens; identical to SEQ ID NO: 814610

SEQ ID NO: 814626 - protein, 77 aa, Homo sapiens; identical to SEQ ID NO: 814610

SEQ ID NO: 814627 - protein, 77 aa, Homo sapiens; identical to SEQ ID NO: 814610

SEQ ID NO: 814628 - protein, 77 aa, Homo sapiens; identical to SEQ ID NO: 814610

SEQ ID NO: 814629 - protein, 77 aa, Homo sapiens; identical to SEQ ID NO: 814610

SEQ ID NO: 814630 - protein, 77 aa, Homo sapiens; identical to SEQ ID NO: 814610

SEQ ID NO: 814631 - protein, 77 aa, Homo sapiens; identical to SEQ ID NO: 814610

SEQ ID NO: 814632 - protein, 77 aa, Homo sapiens; identical to SEQ ID NO: 814610

SEQ ID NO: 814633 - protein, 77 aa, Homo sapiens; identical to SEQ ID NO: 814610

SEQ ID NO: 814634 - protein, 77 aa, Homo sapiens; identical to SEQ ID NO: 814610

SEQ ID NO: 814635 - protein, 77 aa, Homo sapiens; identical to SEQ ID NO: 814610

SEQ ID NO: 814636 - protein, 77 aa, Homo sapiens; identical to SEQ ID NO: 814610

SEQ ID NO: 814637 - protein, 77 aa, Homo sapiens; identical to SEQ ID NO: 814610

SEQ ID NO: 814638 - protein, 77 aa, Homo sapiens; identical to SEQ ID NO: 814610

SEQ ID NO: 814639 - protein, 77 aa, Homo sapiens; identical to SEQ ID NO: 814610

SEQ ID NO: 814640 - protein, 77 aa, Homo sapiens; identical to SEQ ID NO: 814610

SEQ ID NO: 814641 - protein, 77 aa, Homo sapiens; identical to SEQ ID NO: 814610

SEQ ID NO: 814642 - protein, 77 aa, Homo sapiens; identical to SEQ ID NO: 814610

SEQ ID NO: 814643 - protein, 77 aa, Homo sapiens; identical to SEQ ID NO: 814610

SEQ ID NO: 814644 - protein, 77 aa, Homo sapiens; identical to SEQ ID NO: 814610

SEQ ID NO: 814645 - protein, 77 aa, Homo sapiens; identical to SEQ ID NO: 814610

SEQ ID NO: 814646 - protein, 77 aa, Homo sapiens; identical to SEQ ID NO: 814610

SEQ ID NO: 814647 - protein, 77 aa, Homo sapiens; identical to SEQ ID NO: 814610

SEQ ID NO: 814648 - protein, 151 aa, Homo sapiens
SFALNAGAVTAPVFIFSPPIVSPRKTKGRPYFQRPGPKPQLESSYYYSWLFRRLYDFPHSCSLNQGTSIKDENKLSSANGHEERSKKRKKSKSRSRSHERKRSKSKERKRSRDRERKKSKSRERKRSRSKERRRSRSRSRDRRFRGRYRSP

SEQ ID NO: 814649 - protein, 539 aa, Homo sapiens
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLRRDRDKIQGFQAKGEADILAALKKLQDQRQYIVAEFEQGHQFLREREEHLLEQLAKLEQELTEGREKFKSRGVGELARLALVISELEGKAQQPAAELMQDTRDFLNRYPRKKFWVGKPIARVVKKKTGEFSDKLLSLQRGLREFQGKLLRDLEYKTVSVTLDPQSASGYLQLSEDWKCVTYTSLYKSAYLHPQQFDCEPGVLGSKGFTWGKVYWEVEVEREGWSEDEEEGDEEEEGEEEEEEEEAGYGDGYDDWETDEDEESLGDEEEEEEEEEEEVLESCMVGVARDSVKRKGDLSLRPEDGVWALRLSSSGIWANTSPEAELFPALRPRRVGIALDYEGGTVTFTNAESQELIYTFTATFTRRLVPFLWLKWPGTRLLLRP

SEQ ID NO: 814650 - protein, 148 aa, Homo sapiens
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHRNI

SEQ ID NO: 814651 - protein, 539 aa, Homo sapiens; identical to SEQ ID NO: 814649

SEQ ID NO: 814652 - protein, 539 aa, Homo sapiens
MPTSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLRRDRDKIQGFQAKGEADILAALKKLQDQRQYIVAEFEQGHQFLREREEHLLEQLAKLEQELTEGREKFKSRGVGELARLALVISELEGKAQQPAAELMQDTRDFLNRYPRKKFWVGKPIARVVKKKTGEFSDKLLSLQRGLREFQGKLLRDLEYKTVSVTLDPQSASGYLQLSEDWKCVTYTSLYKSAYLHPQQFDCEPGVLGSKGFTWGKVYWEVEVEREGWSEDEEEGDEEEEGEEEEEEEEAGYGDGYDDWETDEDEESLGDEEEEEEEEEEEVLESCMVGVARDSVKRKGDLSLRPEDGVWALRLSSSGIWANTSPEAELFPALRPRRVGIALDYEGGTVTFTNAESQELIYTFTATFTRRLVPFLWLKWPGTRLLLRP

SEQ ID NO: 814653 - protein, 539 aa, Homo sapiens; identical to SEQ ID NO: 814649

SEQ ID NO: 814654 - protein, 381 aa, Homo sapiens
MSWRVPPERLHDNLRSIFHLKKLQDQRQYIVAEFEQGHQFLREREEHLLEQLAKLEQELTEGREKFKSRGVGELARLALVISELEGKAQQPAAELMQDTRDFLNRYPRKKFWVGKPIARVVKKKTGEFSDKLLSLQRGLREFQGKLLRDLEYKTVSVTLDPQSASGYLQLSEDWKCVTYTSLYKSAYLHPQQFDCEPGVLGSKGFTWGKVYWEVEVEREGWSEDEEEGDEEEEGEEEEEEEEAGYGDGYDDWETDEDEESLGDEEEEEEEEEEEVLESCMVGVARDSVKRKGDLSLRPEDGVWALRLSSSGIWANTSPEAELFPALRPRRVGIALDYEGGTVTFTNAESQELIYTFTATFTRRLVPFLWLKWPGTRLLLRP

SEQ ID NO: 814655 - protein, 302 aa, Homo sapiens
LKSYLIHIDTCAFFFPFQDTRDFLNRYPRKKFWVGKPIARVVKKKTGEFSDKLLSLQRGLREFQGKLLRDLEYKTVSVTLDPQSASGYLQLSEDWKCVTYTSLYKSAYLHPQQFDCEPGVLGSKGFTWGKVYWEVEVEREGWSEDEEEGDEEEEGEEEEEEEEAGYGDGYDDWETDEDEESLGDEEEEEEEEEEEVLESCMVGVARDSVKRKGDLSLRPEDGVWALRLSSSGIWANTSPEAELFPALRPRRVGIALDYEGGTVTFTNAESQELIYTFTATFTRRLVPFLWLKWPGTRLLLRP

SEQ ID NO: 814656 - protein, 194 aa, Homo sapiens
GRDAWPKHLEQGTPYPLVATSPLLWPPEIITQGWSEDEEEGDEEEEGEEEEEEEEAGYGDGYDDWETDEDEESLGDEEEEEEEEEEEVLESCMVGVARDSVKRKGDLSLRPEDGVWALRLSSSGIWANTSPEAELFPALRPRRVGIALDYEGGTVTFTNAESQELIYTFTATFTRRLVPFLWLKWPGTRLLLRP

SEQ ID NO: 814657 - protein, 539 aa, Homo sapiens; identical to SEQ ID NO: 814649

SEQ ID NO: 814658 - protein, 539 aa, Homo sapiens; identical to SEQ ID NO: 814649

SEQ ID NO: 814659 - protein, 539 aa, Homo sapiens; identical to SEQ ID NO: 814649

SEQ ID NO: 814660 - protein, 539 aa, Homo sapiens; identical to SEQ ID NO: 814649

SEQ ID NO: 814661 - protein, 205 aa, Homo sapiens
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLRRDRDKIQGFQAKGEADILAALVPTALGLSGHLTTIVSELPTLCVSHAA

SEQ ID NO: 814662 - protein, 260 aa, Homo sapiens
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLRRDRDKIQGFQAKGEADILAALKKLQDQRQYIVAEFEQGHQFLREREEHLLEQLAKLEQELTEGREKFKSRGVGELARLALVISELEGKAQQPAAELMQTRETS

SEQ ID NO: 814663 - protein, 205 aa, Homo sapiens; identical to SEQ ID NO: 814661

SEQ ID NO: 814664 - protein, 355 aa, Homo sapiens [sequence omitted]

SEQ ID NO: 814665 - protein, 346 aa, Homo sapiens
SCRIGTSFRNHQSSYQTRLNALREVQPVELPNCNLVKGIETGSEDLEILPNGLAFISSGLKYPGIKSFNPNSPGKILLMDLNEEDPTVLELGITGSKFDVSSFNPHGISTFTDEDNAMYLLVVNHPDAKSTVELFKFQEEEKSLLHLKTIRHKLLPNLNDIVAVGPEHFYGTNDHYFLDPYLQSWEMYLGLAWSYVVYYSPSEVRVVAEGFDFANGINISPDGKYVYIAELLAHKIHVYEKHANWTLTPLKSLDFNTLVDNISVDPETGDLWVGCHPNGMKIFFYDSENPPASEVLRIQNILTEEPKVTQVYAENGTVLQGSTVASVYKGKLLIGTVFHKALYCEL

SEQ ID NO: 814666 - protein, 268 aa, Homo sapiens
MDLNEEDPTVLELGITGSKFDVSSFNPHGISTFTDEDNAMYLLVVNHPDAKSTVELFKFQEEEKSLLHLKTIRHKLLPNLNDIVAVGPEHFYGTNDHYFLDPYLQSWEMYLGLAWSYVVYYSPSEVRVVAEGFDFANGINISPDGKYVYIAELLAHKIHVYEKHANWTLTPLKSLDFNTLVDNISVDPETGDLWVGCHPNGMKIFFYDSENPPASEVLRIQNILTEEPKVTQVYAENGTVLQGSTVASVYKGKLLIGTVFHKALYCEL

SEQ ID NO: 814667 - protein, 328 aa, Homo sapiens
SCRIGTSFRNHQSSYQTRLNALREVQPVELPNCNLVKGIETGSEDLEILPNGLAFISSGLKYPGIKSFNPNSPGITGSKFDVSSFNPHGISTFTDEDNAMYLLVVNHPDAKSTVELFKFQEEEKSLLHLKTIRHKLLPNLNDIVAVGPEHFYGTNDHYFLDPYLQSWEMYLGLAWSYVVYYSPSEVRVVAEGFDFANGINISPDGKYVYIAELLAHKIHVYEKHANWTLTPLKSLDFNTLVDNISVDPETGDLWVGCHPNGMKIFFYDSENPPASEVLRIQNILTEEPKVTQVYAENGTVLQGSTVASVYKGKLLIGTVFHKALYCEL

SEQ ID NO: 814668 - protein, 337 aa, Homo sapiens
MAKLIALTLLGMGLALFRNHQSSYQTRLNALREVQPVELPNCNLVKGIETGSEDLEILPNGLAFISSGLKYPGIKSFNPNSPGITGSKFDVSSFNPHGISTFTDEDNAMYLLVVNHPDAKSTVELFKFQEEEKSLLHLKTIRHKLLPNLNDIVAVGPEHFYGTNDHYFLDPYLQSWEMYLGLAWSYVVYYSPSEVRVVAEGFDFANGINISPDGKYVYIAELLAHKIHVYEKHANWTLTPLKSLDFNTLVDNISVDPETGDLWVGCHPNGMKIFFYDSENPPASEVLRIQNILTEEPKVTQVYAENGTVLQGSTVASVYKGKLLIGTVFHKALYCEL

SEQ ID NO: 814669 - protein, 150 aa, Homo sapiens
MAKLIALTLLGMGLALFRNHQSSYQTRLNALREVQPVELPNCNLVKGIETGSEDLEILPNGLAFISSGLKYPGIKSFNPNSPGKILLMDLNEEDPTVLELGITGSKFDVSSFNPHGISTFTDEDNAMYLLVVNHPDAKSTVELFKFQEEV

SEQ ID NO: 814670 - protein, 169 aa, Homo sapiens
MAKLIALTLLGMGLALFRNHQSSYQTRLNALREVQPVELPNCNLVKGIETGSEDLEILPNGLAFISSGLKYPGIKSFNPNSPGKILLMDLNEEDPTVLELGITGSKFDVSSFNPHGISTFTDEDNAMYLLVVNHPDAKSTVELFKFQEEEKSLLHLKTIRHKLLPKWHK

SEQ ID NO: 814671 - protein, 152 aa, Homo sapiens
SCRIGTSFRNHQSSYQTRLNALREVQPVELPNCNLVKGIETGSEDLEILPNGLAFISSGLKYPGIKSFNPNSPGITGSKFDVSSFNPHGISTFTDEDNAMYLLVVNHPDAKSTVELFKFQEEEKSLLHLKTIRHKLLPNCLSTEIYHISIFL

SEQ ID NO: 814672 - protein, 760 aa, Homo sapiens
RKEVPLCELMKPLGFSRCTVESLMRRPRRGTHRAAARAAPPCGGPARLRPPLGQCSPGPRDEPAILNCVPAHSDSAGPGMADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTAHRPPQPRVCTFSPQRVSPTTSPRPASPVPGSERRGSRPEMTPVSLRSTKEGPETPPRPRDQLPPHPRSRRYSGDSDSSASSAQSGPLGTRSDDTGTGPRRERPSRRLTTGTPASPRRPPALRSQSRDRLDRGRPRGAPGGRGAQLSVPSPARRARSQSREEQAVLLVRRDRDGQHSWVPRGRGSGGSGRSTPQTPRARSPAAPRLSRVSSPSPELGTTPASIFRTPLQLDPQQEQQLFRRLEEEFLANARALEAVASVTPTGPAPDPARAPDPPAPDSAYCSSSSSSSSLSVLGGKCGQPGDSGRTANGLPGPRSQALSSSSDEGSPCPGMGGPLDAPGSPLACTEPSRTWARGRMDTQPDRKPSRIPTPRGPRRPSGPAELGTWHALHSVTPRAEPDSWM

SEQ ID NO: 814673 - protein, 836 aa, Homo sapiens
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTAHRPPQPRVCTFSPQRVSPTTSPRPASPVPGSERRGSRPEMTPVSLRSTKEGPETPPRLRCRRTRSEGSRGWGGVSPGLHDGLPVRQSDSHPGKSSRGWGRAWLPISMATQPNQQHSWGGPCGWAAASPALASSGPSWEGGCLEPRKLLLPWLLGPWAAGGSCSLLPGSPQDRPMPLTAPSTSHIPCCSSPCLFCMPVLPWYPICLYCPPAPGPRDQLPPHPRSRRYSGDSDSSASSAQSGPLGTRSDDTGTGPRRERPSRRLTTGTPASPRRPPALRSQSRDRLDRGRPRGAPGGRGAQLSVPSPARRARSQSREEQAVLLVRRDRDGQHSWVPRGRGSGGSGRSTPQTPRARSPAAPRLSRVSSPSPELGTTPASIFRTPLQLDPQQEQQLFRRLEEEFLANARALEAVASVTPTGPAPDPARAPDPPAPDSAYCSSSSSSSSLSVLGGKCGQPGDSGRTANGLPGPRSQALSSSSDEGSPCPGMGGPLDAPGSPLACTEPSRTWARGRMDTQPDRKPSRIPTPRGPRRPSGPAELGTWHALHSVTPRAEPDSWM

SEQ ID NO: 814674 - protein, 836 aa, Homo sapiens; identical to SEQ ID NO: 814673

SEQ ID NO: 814675 - protein, 329 aa, Homo sapiens
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTGPGISCPPIPAPAATPGTVTPQPPPPRAAPLVPAVMTQALAPGGSDPAGG

SEQ ID NO: 814676 - protein, 836 aa, Homo sapiens; identical to SEQ ID NO: 814673

SEQ ID NO: 814677 - protein, 681 aa, Homo sapiens
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTAHRPPQPRVCTFSPQRVSPTTSPRPASPVPGSERRGSRPEMTPVSLRSTKEGPETPPRPRDQLPPHPRSRRYSGDSDSSASSAQSGPLGTRSDDTGTGPRRERPSRRLTTGTPASPRRPPALRSQSRDRLDRGRPRGAPGGRGAQLSVPSPARRARSQSREEQAVLLVRRDRDGQHSWVPRGRGSGGSGRSTPQTPRARSPAAPRLSRVSSPSPELGTTPASIFRTPLQLDPQQEQQLFRRLEEEFLANARALEAVASVTPTGPAPDPARAPDPPAPDSAYCSSSSSSSSLSVLGGKCGQPGDSGRTANGLPGPRSQALSSSSDEGSPCPGMGGPLDAPGSPLACTEPSRTWARGRMDTQPDRKPSRIPTPRGPRRPSGPAELGTWHALHSVTPRAEPDSWM

SEQ ID NO: 814678 - protein, 715 aa, Homo sapiens
SKVTNHMLTVSCLDKLDMWLLESSDELSIMYDQYITQELVRIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTAHRPPQPRVCTFSPQRVSPTTSPRPASPVPGSERRGSRPEMTPVSLRSTKEGPETPPRPRDQLPPHPRSRRYSGDSDSSASSAQSGPLGTRSDDTGTGPRRERPSRRLTTGTPASPRRPPALRSQSRDRLDRGRPRGAPGGRGAQLSVPSPARRARSQSREEQAVLLVRRDRDGQHSWVPRGRGSGGSGRSTPQTPRARSPAAPRLSRVSSPSPELGTTPASIFRTPLQLDPQQEQQLFRRLEEEFLANARALEAVASVTPTGPAPDPARAPDPPAPDSAYCSSSSSSSSLSVLGGKCGQPGDSGRTANGLPGPRSQALSSSSDEGSPCPGMGGPLDAPGSPLACTEPSRTWARGRMDTQPDRKPSRIPTPRGPRRPSGPAELGTWHALHSVTPRAEPDSWM

SEQ ID NO: 814679 - protein, 610 aa, Homo sapiens
MIKVSEGKYRVGDSSLLIFVRVLRSHVMVRVGGGWDTLEHYLDKHDPCRCSSTAHRPPQPRVCTFSPQRVSPTTSPRPASPVPGSERRGSRPEMTPVSLRSTKEGPETPPRLRCRRTRSEGSRGWGGVSPGLHDGLPVRQSDSHPGKSSRGWGRAWLPISMATQPNQQHSWGGPCGWAAASPALASSGPSWEGGCLEPRKLLLPWLLGPWAAGGSCSLLPGSPQDRPMPLTAPSTSHIPCCSSPCLFCMPVLPWYPICLYCPPAPGPRDQLPPHPRSRRYSGDSDSSASSAQSGPLGTRSDDTGTGPRRERPSRRLTTGTPASPRRPPALRSQSRDRLDRGRPRGAPGGRGAQLSVPSPARRARSQSREEQAVLLVRRDRDGQHSWVPRGRGSGGSGRSTPQTPRARSPAAPRLSRVSSPSPELGTTPASIFRTPLQLDPQQEQQLFRRLEEEFLANARALEAVASVTPTGPAPDPARAPDPPAPDSAYCSSSSSSSSLSVLGGKCGQPGDSGRTANGLPGPRSQALSSSSDEGSPCPGMGGPLDAPGSPLACTEPSRTWARGRMDTQPDRKPSRIPTPRGPRRPSGPAELGTWHALHSVTPRAEPDSWM

SEQ ID NO: 814680 - protein, 292 aa, Homo sapiens
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDTAELGTWHALHSVTPRAEPDSWM

SEQ ID NO: 814681 - protein, 143 aa, Homo sapiens
GIPRSQEAVSPGVLGQPCLPTRRMKVSVAALSCLMLVTALGSQARVTKDAETEFMMSKLPLENPVLLDRFHATSADCCISYTPRSIPCSLLESYFETNSECSKPGVIFLTKKGRRFCANPSDKQVQVCMRMLKLDTRIKTRKN

SEQ ID NO: 814682 - protein, 160 aa, Homo sapiens
GIPRSQEAVSPGVLGQPCLPTRRMKVSVAALSCLMLVTALGSQARVTKDAETEFMMSKLPLENPVLLDMLWRRKIGPQMTLSHAAGFHATSADCCISYTPRSIPCSLLESYFETNSECSKPGVIFLTKKGRRFCANPSDKQVQVCMRMLKLDTRIKTRKN

SEQ ID NO: 814683 - protein, 84 aa, Homo sapiens
GIPRSQEAVSPGVLGQPCLPTRRMKVSVAALSCLMLVTALGSQARVTKDAETGGQGGGGFHLKNQDFWTCFWREKDGALKIPLF

SEQ ID NO: 814684 - protein, 723 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 814685 - protein, 723 aa, Homo sapiens; identical to SEQ ID NO: 814684

SEQ ID NO: 814686 - protein, 723 aa, Homo sapiens; identical to SEQ ID NO: 814684

SEQ ID NO: 814687 - protein, 723 aa, Homo sapiens; identical to SEQ ID NO: 814684

SEQ ID NO: 814688 - protein, 723 aa, Homo sapiens; identical to SEQ ID NO: 814684

SEQ ID NO: 814689 - protein, 500 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAPPARCTATPSSI

SEQ ID NO: 814690 - protein, 830 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQEARVQGMNDPEMVRVGGALWQLRSNLDSPEDNICGAKRTQGVLQGGGLGTSVVPCGGEDFSLAGVLKIPFVLLNPCFMYVSSSLPLQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 814691 - protein, 706 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALAASPASVAVDSGSELNSRSSTLSSSSMSLSPKLCAEKEAATSELQSIQRLVSGLEAKPDRSRSASP

SEQ ID NO: 814692 - protein, 391 aa, Homo sapiens
MNALLPWFFPSPVVDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 814693 - protein, 150 aa, Homo sapiens [sequence omitted]

SEQ ID NO: 814694 - protein, 356 aa, Homo sapiens
ISVDPRVRSPPTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 814695 - protein, 243 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFVSFIALFSKIFSSFTQSKAVLPIS

SEQ ID NO: 814696 - protein, 622 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSP

SEQ ID NO: 814697 - protein, 670 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPLPFAVASGKGPRTPSRECARDSPCLLGVVYMSGIWIRFWGLRNVGCIELLGVGVPTFMSRATSSKAGLGLCPPGGEVFKDISLSADLYIYFSFTVSSGNKNKIFQKKNRDK

SEQ ID NO: 814698 - protein, 204 aa, Homo sapiens
MSQPAGGLGLSPRPHDHPVSTPVPFPWLPGCDCHVAADPLFVLEHSLPIDTQYYLEQQLAKPLLRIFEPILGEGRAEAVLLRGDHTRCKTVLTGKVGGLLAFAKRRNCCIGCRTVLSHQGAVCEFCQPRESELYQKEVSHLNALEERFSRLWTQCQRCQGSLHEDVICTSRDCPIFYMRKKVRKDLEDQEQLLRRFGPPGPEAW

SEQ ID NO: 814699 - protein, 204 aa, Homo sapiens; identical to SEQ ID NO: 814698

SEQ ID NO: 814700 - protein, 1107 aa, Homo sapiens
MDGKRRPGPGPGVPPKRARGGLWDDDDAPRPSQFEEDLALMEEMEAEHRLQEQEEEELQSVLEGVADGQVPPSAIDPRWLRPTPPALDPQTEPLIFQQLEIDHYVGPAQPVPGGPPPSRGSVPVLRAFGVTDEGFSVCCHIHGFAPYFYTPAPPGFGPEHMGDLQRELNLAISRDSRGGRELTGPAVLAVELCSRESMFGYHGHGPSPFLRITVALPRLVAPARRLLEQGIRVAGLGTPSFAPYEANVDFEIRFMVDTDIVGCNWLELPAGKYALRLKEKATQCQLEADVLWSDVVSHPPEGPWQRIAPLRVLSFDIECAGRKGIFPEPERDPVIQICSLGLRWGEPEPFLRLALTLRPCAPILGAKVQSYEKEEDLLQAWSTFIRIMDPDVITGYNIQNFDLPYLISRAQTLKVQTFPFLGRVAGLCSNIRDSSFQSKQTGRRDTKVVSMVGRVQMDMLQVLLREYKLRSYTLNAVSFHFLGEQKEDVQHSIITDLQNGNDQTRRRLAVYCLKDAYLPLRLLERLMVLVNAVEMARVTGVPLSYLLSRGQQVKVVSQLLRQAMHEGLLMPVVKSEGGEDYTGATVIEPLKGYYDVPIATLDFSSLYPSIMMAHNLCYTTLLRPGTAQKLGLTEDQFIRTPTGDEFVKTSVRKGLLPQILENLLSARKRAKAELAKETDPLRRQVLDGRQLALKVSANSVYGFTGAQVGKLPCLEISQSVTGFGRQMIEKTKQLVESKYTVENGYSTSAKVVYGDTDSVMCRFGVSSVAEAMALGREAADWVSGHFPSPIRLEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERMRKRDPGSAPSLGDRVPYVIISAAKGVAAYMKSEDPLFVLEHSLPIDTQYYLEQQLAKPLLRIFEPILGEGRAEAVLLRGDHTRCKTVLTGKVGGLLAFAKRRNCCIGCRTVLSHQGAVCEFCQPRESELYQKEVSHLNALEERFSRLWTQCQRCQGSLHEDVICTSRDCPIFYMRKKVRKDLEDQEQLLRRFGPPGPEAW

SEQ ID NO: 814701 - protein, 202 aa, Homo sapiens
MDGKRRPGPGPGVPPKRARGGLWDDDDAPRPSQFEEDLALMEEMEAEHRLQEQEEEELQSVLEGVADGQVPPSAIDPRWLRPTPPALDPQTEPLIFQQLEIDHYVGQTGCAGGPTFQGSGWVRARGTETVPVRPSPVVPILNQALVLATTCGARANGHRELAAEELGRCLNTPKFEEGPLKGGFTPLHKWDGATHNRMHTHN

SEQ ID NO: 814702 - protein, 188 aa, Homo sapiens
VLPGREFHIRRILILNLDRILALPILCSIILPHHRNVRPDLLPKPQHLCKHLHGVIELFGPVASRLSVGDLIDNGFARVDKWLKPADVQFGMNASWMAAVCSQGAVCEFCQPRESELYQKEVSHLNALEERFSRLWTQCQRCQGSLHEDVICTSRDCPIFYMRKKVRKDLEDQEQLLRRFGPPGPEAW

SEQ ID NO: 814703 - protein, 115 aa, Homo sapiens
LSEAGIGSGQGWGGPVPGWAPALGLTRLPTGAVCEFCQPRESELYQKEVSHLNALEERFSRLWTQCQRCQGSLHEDVICTSRDCPIFYMRKKVRKDLEDQEQLLRRFGPPGPEAW

SEQ ID NO: 814704 - protein, 86 aa, Homo sapiens
RLRLGSEALGGESELYQKEVSHLNALEERFSRLWTQCQRCQGSLHEDVICTSRDCPIFYMRKKVRKDLEDQEQLLRRFGPPGPEAW

SEQ ID NO: 814705 - protein, 1107 aa, Homo sapiens; identical to SEQ ID NO: 814700

SEQ ID NO: 814706 - protein, 1083 aa, Homo sapiens
MDGKRRPGPGPGVPPKRARGGLWDDDDAPRPSQFEEDLALMEEMEAEHRLQEQEEEELQSVLEGVADGQVPPSAIDPRWLRPTPPALDPQTEPLIFQQLEIDHYVGPAQPVPGGPPPSRGSVPVLRAFGVTDEGFSVCCHIHGFAPYFYTPAPPGFGPEHMGDLQRELNLAISRDSRGGRELTGPAVLAVELCSRESMFGYHGHGPSPFLRITVALPRLVAPARRLLEQGIRVAGLGTPSFAPYEANVDFEIRFMVDTDIVGCNWLELPAGKYALRLKEKATQCQLEADVLWSDVVSHPPEGPWQRIAPLRVLSFDIECAGRKGIFPEPERDPVIQICSLGLRWGEPEPFLRLALTLRPCAPILGAKVQSYEKEEDLLQAWSTFIRIMDPDVITGYNIQNFDLPYLISRAQTLKVQTFPFLGRVAGLCSNIRDSSFQSKQTGRRDTKVVSMVGRVQMDMLQVLLREYKLRSYTLNAVSFHFLGEQKEDVQHSIITDLQNGNDQTRRRLAVYCLKDAYLPLRLLERLMVLVNAVEMARVTGVPLSYLLSRGQQVKVVSQLLRQAMHEGLLMPVVKSEGGEDYTGATVIEPLKGYYDVPIATLDFSSLYPSIMMAHNLCYTTLLRPGTAQKLGLTEDQFIRTPTGDEFVKTSVRKGLLPQILENLLSARKRAKAELAKETDPLRRQVLDGRQLALKSVTGFGRQMIEKTKQLVESKYTVENGYSTSAKVVYGDTDSVMCRFGVSSVAEAMALGREAADWVSGHFPSPIRLEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERMRKRDPGSAPSLGDRVPYVIISAAKGVAAYMKSEDPLFVLEHSLPIDTQYYLEQQLAKPLLRIFEPILGEGRAEAVLLRGDHTRCKTVLTGKVGGLLAFAKRRNCCIGCRTVLSHQGAVCEFCQPRESELYQKEVSHLNALEERFSRLWTQCQRCQGSLHEDVICTSRDCPIFYMRKKVRKDLEDQEQLLRRFGPPGPEAW

SEQ ID NO: 814707 - protein, 1107 aa, Homo sapiens; identical to SEQ ID NO: 814700

SEQ ID NO: 814708 - protein, 1133 aa, Homo sapiens
MDGKRRPGPGPGVPPKRARGGLWDDDDAPRPSQFEEDLALMEEMEAEHRLQEQEEEELQSVLEGVADGQVPPSAIDPRWLRPTPPALDPQTEPLIFQQLEIDHYVGPAQPVPGGPPPSRGSVPVLRAFGVTDEGFSVCCHIHGFAPYFYTPAPPGFGPEHMGDLQRELNLAISRDSRGGRELTGPAVLAVELCSRESMFGYHGHGPSPFLRITVALPRLVAPARRLLEQGIRVAGLGTPSFAPYEANVDFEIRFMVDTDIVGCNWLELPAGKYALRLKEKATQCQLEADVLWSDVVSHPPEGPWQRIAPLRVLSFDIECAGRKGIFPEPERDPVIQICSLGLRWGEPEPFLRLALTLRPCAPILGAKVQSYEKEEDLLQAWSTFIRIMDPDVITGYNIQNFDLPYLISRAQTLKVQTFPFLGRVAGLCSNIRDSSFQSKQTGRRDTKVVSMVGRVQMDMLQVLLREYKLRSYTLNAVSFHFLGEQKEDVQHSIITDLQNGNDQTRRRLAVYCLKDAYLPLRLLERLMVLVNAVEMARVTGVPLSYLLSRGQQVKVVSQLLRQAMHEGLLMPVVKSEGGEDYTGATVIEPLKGVRPQDRAGAAWELLALTPGRGCSPPRYYDVPIATLDFSSLYPSIMMAHNLCYTTLLRPGTAQKLGLTEDQFIRTPTGDEFVKTSVRKGLLPQILENLLSARKRAKAELAKETDPLRRQVLDGRQLALKVSANSVYGFTGAQVGKLPCLEISQSVTGFGRQMIEKTKQLVESKYTVENGYSTSAKVVYGDTDSVMCRFGVSSVAEAMALGREAADWVSGHFPSPIRLEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERMRKRDPGSAPSLGDRVPYVIISAAKGVAAYMKSEDPLFVLEHSLPIDTQYYLEQQLAKPLLRIFEPILGEGRAEAVLLRGDHTRCKTVLTGKVGGLLAFAKRRNCCIGCRTVLSHQGAVCEFCQPRESELYQKEVSHLNALEERFSRLWTQCQRCQGSLHEDVICTSRDCPIFYMRKKVRKDLEDQEQLLRRFGPPGPEAW

SEQ ID NO: 814709 - protein, 1107 aa, Homo sapiens; identical to SEQ ID NO: 814700

SEQ ID NO: 814710 - protein, 1107 aa, Homo sapiens; identical to SEQ ID NO: 814700

SEQ ID NO: 814711 - protein, 706 aa, Homo sapiens
GGVGCGGKRCLKRVQTFPFLGRVAGLCSNIRDSSFQSKQTGRRDTKVVSMVGRVQMDMLQVLLREYKLRSYTLNAVSFHFLGEQKEDVQHSIITDLQNGNDQTRRRLAVYCLKDAYLPLRLLERLMVLVNAVEMARVTGVPLSYLLSRGQQVKVVSQLLRQAMHEGLLMPVVKSEGGEDYTGATVIEPLKGYYDVPIATLDFSSLYPSIMMAHNLCYTTLLRPGTAQKLGLTEDQFIRTPTGDEFVKTSVRKGLLPQILENLLSARKRAKAELAKETDPLRRQVLDGRQLALKVSANSVYGFTGAQVGKLPCLEISQSVTGFGRQMIEKTKQLVESKYTVENGYSTSAKVVYGDTDSVMCRFGVSSVAEAMALGREAADWVSGHFPSPIRLEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERMRKRDPGSAPSLGDRVPYVIISAAKGVAAYMKSEDPLFVLEHSLPIDTQYYLEQQLAKPLLRIFEPILGEGRAEAVLLRGDHTRCKTVLTGKVGGLLAFAKRRNCCIGCRTVLSHQGAVCEFCQPRESELYQKEVSHLNALEERFSRLWTQCQRCQGSLHEDVICTSRDCPIFYMRKKVRKDLEDQEQLLRRFGPPGPEAW

SEQ ID NO: 814712 - protein, 2131 aa, Homo sapiens
ARGTVLSYCETLLEPECSSRVAGRPQCKQIDQSSSDQTRNEGEAPGFHVASLSAEAGQIDLLPDERKVQATSLSADSFESLPNTETDREPWDPVQAFSHAAPAQDRKRRTGELRQFAGASEPFICHSSSSEIIEKKKDATRTPSSADPLAPDSPRSSAPVEEVRRVVSKKVVAALPSQAPYDDPRVTLHELSQSVPQETAEGIPPGSQDSSPEHQEPRTLDTTYGEVSDNLLVTAQGEKTAHFESQSVTCDVQNSTSASGPKQDHVQCPEASTGFEEGRASPKQDTILPGALTRVALEAPTQQCVQCKESVGSGLTEVCRAGSKHSRPIPLPDQRPSANPGGIGEEAPCRHPREALDGPVFSRNPEGSRTLSPSRGKESRTLPCRQPCSSQPVATHAYSSHSSTLLCFRDGDLGKEPFKAAPHTIHPPCVVPSRAYEMDETGEISRGPDVHLTHGLEPKDVNREFRLTESSTCEPSTVAAVLSRAQGCRSPSAPDVRTGSFSHSATDGSVGLIGVPEKKVAEKQASTELEAASFPAGMYSEPLRQFRDSSVGDQNAQVCQTNPEPPATTQGPHTLDLSEGSAESKLVVEPQHECLENTTRCFLEKPQFSTELRDHNRLDSQAKFVARLKHTCSPQEDSPWQEEEQHRDQASGGGEGFAQGVNPLPDEDGLDGCQILDAGREEVAVAKPPVSKILSQGFKDPATVSLRQNETPQPAAQRSGHLYTGREQPAPNHRGSLPVTTIFSGPKHSRSSPTPQFSVVGSSRSLQELNLSVEPPSPTDEDTQGPNRLWNPHLRGYSSGKSVARTSLQAEDSNQKASSRLDDGTTDHRHLKPATPPYPMPSTLSHMPTPDFTTSWMSGTLEQAQQGKREKLGVQVRPENWCSQMDKGMLHFGSSDISPYALPWRPEEPARISWKQYMSGSAVDVSCSQKPQGLTLSNVARCSSMDNGLEDQNSPFHSHLSTYANICDLSTTHSSTENAQGSNEAWEVFRGSSSIALGDPHIPTSPEGVAPTSGHDRRPQFRGPSGEADCLRSKPPLAKGSAAGPVDEIMLLYPSEAGCPVGQTRTNTFEQGTQTLGSRRHWSSTDISFAQPEASAVSAFDLASWTSMHNLSLHLSQLLHSTSELLGSLSQPDVARREQNTKRDIPDKAPQALMMDGSTQTTVDEGSQTDLTLPTLCLQTSEAEPQGANVILEGLGSDTSTVSQEEGDVPGVPQKREAEETAQKMAQLLYLQEESTPYKPQSPSIPSSHLRFQKAPVGQHLPSVSPSVSDAFLPPSSQPEESYCLVVSSPSPSSPHSPGLFPSTSEYPGDSRVQKKLGPTSALFVDRASSPILTLSASTQEPGLSPGSLTLSAPSTHPVEGHQKLDSSPDPVDAPRTPMDNYSQTTDELGGSQRGRSSLQRSNGRSFLELHSPHSPQQSPKLQFSFLGQHPQQLQPRTTIGVQSRLLPPPLRHRSQRLGNSFVPEKVASPEHCPLSGREPSQWQSRTENGGESSASPGEPQRTLDRPSSWGGLQHLSPCPVSELTDTAGLRGSALGLPQACQPEELLCFSCQMCMAPEHQHHSLRDLPVHNKFSNWCGVQKGSPGGLDMTEEELGASGDLSSEKQEQSPPQPPNDHSQDSEWSKREQIPLQVGAQNLSLSVELTEAKLHHGFGEADALLQVLQSGTGEALAADEPVTSTWKELYARQKKAIETLRRERAERLGNFCRTRSLSPQKQLSLLPNKDLFIWDLDLPSRRREYLQQLRKDVVETTRSPESVSRSAHTPSDIELMLQDYQQAHEEAKVEIARARDQLRERTEQEKLRIHQKIISQLLKEEDKLHTLANSSSLCTSSNGSLSSGMTSGYNSSPALSGQLQFPENMGHTNLPDSRDVWIGDERGGHSAVRKNSAYSHRASLGSCCCSPSSLSSLGTCFSSSYQDLAKHVVDTSMADVMAACSDNLHNLFSCQATAGWNYQGEEQAVQLYYKVFSPTRHGFLGAGVVSQPLSRVWAAVSDPTVWPLYYKPIQTARLHQRVTNSISLVYLVCNTTLCALKQPRDFCCVCVEAKEGHLSVMAAQSVYDTSMPRPSRKMVRGEILPSAWILQPITVEGKEVTRVIYLAQVELGAPGFPPQLLSSFIKRQPLVIARLASFLGR

SEQ ID NO: 814713 - protein, 530 aa, Homo sapiens
MSSPFESPPQPPNDHSQDSEWSKREQIPLQVGAQNLSLSVELTEAKLHHGFGEADALLQVLQSGTGEALAADEPVTSTWKELYARQKKAIETLRRERAERLGNFCRTRSLSPQKQLSLLPNKDLFIWDLDLPSRRREYLQQLRKDVVETTRSPESVSRSAHTPSDIELMLQDYQQAHEEAKVEIARARDQLRERTEQEKLRIHQKIISQLLKEEDKLHTLANSSSLCTSSNGSLSSGMTSGYNSSPALSGQLQFPENMGHTNLPDSRDVWIGDERGGHSAVRKNSAYSHRASLGSCCCSPSSLSSLGTCFSSSYQDLAKHVVDTSMADVMAACSDNLHNLFSCQATAGWNYQGEEQAVQLYYKVFSPTRHGFLGAGVVSQPLSRVWAAVSDPTVWPLYYKPIQTARLHQRVTNSISLVYLVCNTTLCALKQPRDFCCVCVEAKEGHLSVMAAQSVYDTSMPRPSRKMVRGEILPSAWILQPITVEGKEVTRVIYLAQVELGAPGFPPQLLSSFIKRQPLVIARLASFLGR

SEQ ID NO: 814714 - protein, 2104 aa, Homo sapiens
ARGTVLSYCETLLEPECSSRVAGRPQCKQIDQSSSDQTRNEGEAPGFHVASLSAEAGQIDLLPDERKVQATSLSADSFESLPNTETDREPWDPVQAFSHAAPAQDRKRRTGELRQFAGASEPFICHSSSSEIIEKKKDATRTPSSADPLAPDSPRSSAPVEEVRRVVSKKVVAALPSQAPYDDPRVTLHELSQSVPQETAEGIPPGSQDSSPEHQEPRTLDTTYGEVSDNLLVTAQGEKTAHFESQSVTCDVQNSTSASGPKQDHVQCPEASTGFEEGRASPKQDTILPGALTRVALEAPTQQCVQCKESVGSGLTEVCRAGSKHSRPIPLPDQRPSANPGGIGEEAPCRHPREALDGPVFSRNPEGSRTLSPSRGKESRTLPCRQPCSSQPVATHAYSSHSSTLLCFRDGDLGKEPFKAAPHTIHPPCVVPSRAYEMDETGEISRGPDVHLTHGLEPKDVNREFRLTESSTCEPSTVAAVLSRAQGCRSPSAPDVRTGSFSHSATDGSVGLIGVPEKKVAEKQASTELEAASFPAGMYSEPLRQFRDSSVGDQNAQVCQTNPEPPATTQGPHTLDLSEGSAESKLVVEPQHECLENTTRCFLEKPQFSTELRDHNRLDSQAKFVARLKHTCSPQEDSPWQEEEQHRDQASGGGEGFAQGVNPLPDEDGLDGCQILDAGREEVAVAKPPVSKILSQGFKDPATVSLRQNETPQPAAQRSGHLYTGREQPAPNHRGSLPVTTIFSGPKHSRSSPTPQFSVVGSSRSLQELNLSVEPPSPTDEDTQGPNRLWNPHLRGYSSGKSVARTSLQAEDSNQKASSRLDDGTTDHRHLKPATPPYPMPSTLSHMPTPDFTTSWMSGTLEQAQQGKREKLGVQVRPENWCSQMDKGMLHFGSSDISPYALPWRPEEPARISWKQYMSGSAVDVSCSQKPQGLTLSNVARCSSMDNGLEDQNSPFHSHLSTYANICDLSTTHSSTENAQGSNEAWEVFRGSSSIALGDPHIPTSPEGVAPTSGHDRRPQFRGPSGEADCLRSKPPLAKGSAAGPVDEIMLLYPSEAGCPVGQTRTNTFEQGTQTLGSRRHWSSTDISFAQPEASAVSAFDLASWTSMHNLSLHLSQLLHSTSELLGSLSQPDVARREQNTKRDIPDKAPQALMMDGSTQTTVDEGSQTDLTLPTLCLQTSEAEPQGANVILEGLGSDTSTVSQEEGDVPGVPQKREAEETAQKMAQLLYLQEESTPYKPQSPSIPSSHLRFQKAPVGQHLPSVSPSVSDAFLPPSSQPEESYCLVVSSPSPSSPHSPGLFPSTSEYPGDSRVQKKLGPTSALFVDRASSPILTLSASTQEPGLSPGSLTLSAPSTHPVEGHQKLDSSPDPVDAPRTPMDNYSQTTDELGGSQRGRSSLQRSNGRSFLELHSPHSPQQSPKLQFSFLGQHPQQLQPRTTIGVQSRLLPPPLRHRSQRLGNSFVPEKVASPEHCPLSGREPSQWQSRTENGGESSASPGEPQRTLDRPSSWGGLQHLSPCPVSELTDTAGLRGSALGLPQACQPEELLCFSCQMCMAPEHQHHSLRDLPVHNKFSNWCGVQKGSPGGLDMTEEELGASGDLSSEKQEQSPPQPPNDHSQDSEWSKREQIPLQVGAQNLSLSVELTEAKLHHGFGEADALLQVLQSGTGEALAADEPVTSTWKELYARQKKAIETLRRERAERLGNFCRTRSLSPQKQLSLLPNKDLFIWDLDLPSRRREYLQQLRKDVVETTRSPESVSRSAHTPSDIELMLQDYQQAHEEAKVEIARARDQLRERTEQEKLRIHQKIISQLLKEEDKLHTLANSSSLCTSSNGSLSSGMTSGYNSSPALSGQLQFPENMGHTNLPDSRDVWIGDERGGHSAVRKNSAYSHRASLGSCCCSPSSLSSLGTCFSSSYQDLAKHVVDTSMADVMAACSDNLHNLFSCQATAGWNYQGEEQAVQLYYKVFSPTRHGFLGAGVVSQPLSRVWAAVSDPTVWPLYYKPIQTARLHQRVTNSISLVYLVCNTTLCALKQPRDFCCVCVEAKEGHLSVMAAQSVYDTSMPRPSRKMVRGEILPSAWILQPITVEGKEVTRVIYLAQEVNANT

SEQ ID NO: 814715 - protein, 469 aa, Homo sapiens
MELISPTVIIILGCLALFLLLQRKNLRRPPCIKGWIPWIGVGFEFGKAPLEFIEKARIKYGPIFTVFAMGNRMTFVTEEEGINVFLKSKKVDFELAVQNIVYRTASIPKNVFLALHEKLYIMLKGKMGTVNLHQFTGQLTEELHEQLENLGTHGTMDLNNLVRHLLYPVTVNMLFNKSLFSTNKKKIKEFHQYFQVYDEDFEYGSQLPECLLRNWSKSKKWFLELFEKNIPDIKACKSAKDNSMTLLQATLDIVETETSKENSPNYGLLLLWASLSNAVPVAFWTLAYVLSHPDIHKAIMEGISSVFGKAGKDKIKVSEDDLENLLLIKWCVLETIRLKAPGVITRKVVKPVEILNYIIPSGDLLMLSPFWLHRNPKYFPEPELFKPERWKKANLEKHSFLDCFMAFGSGKFQCPARWFALLEVQMCIILILYKYDCSLLDPLPKQSYLHLVGVPQPEGQCRIEYKQRI

SEQ ID NO: 814716 - protein, 433 aa, Homo sapiens
MELISPTVIIILGCLALFLLLQRKNLRRPPCIKGWIPWIGVGFEFGKAPLEFIEKARIKYGPIFTVFAMGNRMTFVTEEEGINVFLKSKKVDFELAVQNIVYRTASIPKNVFLALHEKLYIMLKGKMGTVNLHQFTGQLTEELHEQLENLGTHGTMDLNNLVRHLLYPVTVNMLFNKSLFSTNKKKIKEFHQYFQVYDEDFEYGSQLPECLLRNWSKSKKWFLELFEKNIPDIKACKSAKDNSMVAFWTLAYVLSHPDIHKAIMEGISSVFGKAGKDKIKVSEDDLENLLLIKWCVLETIRLKAPGVITRKVVKPVEILNYIIPSGDLLMLSPFWLHRNPKYFPEPELFKPERWKKANLEKHSFLDCFMAFGSGKFQCPARWFALLEVQMCIILILYKYDCSLLDPLPKQSYLHLVGVPQPEGQCRIEYKQRI

SEQ ID NO: 814717 - protein, 433 aa, Homo sapiens; identical to SEQ ID NO: 814716

SEQ ID NO: 814718 - protein, 433 aa, Homo sapiens; identical to SEQ ID NO: 814716

SEQ ID NO: 814719 - protein, 435 aa, Homo sapiens
MELISPTVIIILGCLALFLLLQRKNLRRPPCIKGWIPWIGVGFEFGKAPLEFIEKARIKYGPIFTVFAMGNRMTFVTEEEGINVFLKSKKVDFELAVQNIVYRTASIPKNVFLALHEKLYIMLKGKMGTVNLHQFTGQLTEELHEQLENLGTHGTMDLNNLVRHLLYPVTVNMLFNKSLFSTNKKKIKEFHQYFQVYDEDFEYGSQLPECLLRNWSKSKKWFLELFEKNIPDIKACKSAKDNSMVAFWTLAYVLSHPDIHKAIMEGISSVFGKAGKDKIKVSEDDLENLLLIKWCVLETIRLKAPGVITRKVVKPVEILNYIIPSGDLLMLSPFWLHRNPKYFPEPELFKPERWKKANLEKHSFLDCFMAFGSGKFQCPARKTNRKEQHEPPDFFRNCSLQSEESHYSRQSHIKLYDLNGGIRRRVFSVEENFFE

SEQ ID NO: 814720 - protein, 384 aa, Homo sapiens
MELISPTVIIILGCLALFLLLQRKNLRRPPCIKGWIPWIGVGFEFGKAPLEFIEKARIKYGPIFTVFAMGNRMTFVTEEEGINVFLKSKKVDFELAVQNIVYRTASIPKNVFLALHEKLYIMLKGKMGTVNLHQFTGQLTEELHEQLENLGTHGTMDLNNLVRHLLYPVTVNMLFNKSLFSTNKKKIKEFHQYFQVYDEDFEYGSQLPECLLRNWSKSKKWFLELFEKNIPDIKACKSAKDNSMVAFWTLAYVLSHPDIHKAIMEGISSVFGKAGKDKIKVSEDDLENLLLIKWCVLETIRLKAPGVITRKVVKPVEILNYIIPSGDLLMLSPFWLHRNPKYFPEPELFKPERWKKANLEKHSFLDCFMAFGSGKFQCPARKGF

SEQ ID NO: 814721 - protein, 279 aa, Homo sapiens
MSRERPPGTDIPRNLSFIAALTERAYYRSQRPSLEEEPEEEPGEGGTRFGARSRAHAPSRGRRARSAPAGGGGARAPRSRSPDTRKRVRFADALGLELAVVRRFRPGELPRVPRHVQIQLQRDALRHFAPCQPRARGLQEARAALEPASEPGFAARLLTQRICLERAEAGPLGVAGSARVVDLAYEKRVSVRWSADGWRSQREAPAAYAGPAPPPPRADRFAFRLPAPPIGGALLFALRYRVTGHEFWDNNGGRDYALRGPEHPGSGGAPEPQGWIHFI

SEQ ID NO: 814722 - protein, 279 aa, Homo sapiens; identical to SEQ ID NO: 814721

SEQ ID NO: 814723 - protein, 279 aa, Homo sapiens; identical to SEQ ID NO: 814721

SEQ ID NO: 814724 - protein, 279 aa, Homo sapiens; identical to SEQ ID NO: 814721

SEQ ID NO: 814725 - protein, 279 aa, Homo sapiens; identical to SEQ ID NO: 814721

SEQ ID NO: 814726 - protein, 279 aa, Homo sapiens; identical to SEQ ID NO: 814721

SEQ ID NO: 814727 - protein, 279 aa, Homo sapiens; identical to SEQ ID NO: 814721

SEQ ID NO: 814728 - protein, 279 aa, Homo sapiens; identical to SEQ ID NO: 814721

SEQ ID NO: 814729 - protein, 279 aa, Homo sapiens; identical to SEQ ID NO: 814721

SEQ ID NO: 814730 - protein, 279 aa, Homo sapiens; identical to SEQ ID NO: 814721

SEQ ID NO: 814731 - protein, 279 aa, Homo sapiens; identical to SEQ ID NO: 814721

SEQ ID NO: 814732 - protein, 279 aa, Homo sapiens; identical to SEQ ID NO: 814721

SEQ ID NO: 814733 - protein, 279 aa, Homo sapiens; identical to SEQ ID NO: 814721

SEQ ID NO: 814734 - protein, 279 aa, Homo sapiens; identical to SEQ ID NO: 814721

SEQ ID NO: 814735 - protein, 279 aa, Homo sapiens; identical to SEQ ID NO: 814721

SEQ ID NO: 814736 - protein, 279 aa, Homo sapiens; identical to SEQ ID NO: 814721

SEQ ID NO: 814737 - protein, 279 aa, Homo sapiens; identical to SEQ ID NO: 814721

SEQ ID NO: 814738 - protein, 279 aa, Homo sapiens; identical to SEQ ID NO: 814721

SEQ ID NO: 814739 - protein, 279 aa, Homo sapiens; identical to SEQ ID NO: 814721

SEQ ID NO: 814740 - protein, 333 aa, Homo sapiens [sequence omitted]

SEQ ID NO: 814741 - protein, 333 aa, Homo sapiens [sequence omitted]

SEQ ID NO: 814742 - protein, 151 aa, Homo sapiens
MDYAFQYVQDNGGLDSEESYPYEATEESCKYNPKYSVANDTGFVDIPKQEKALMKAVATVGPISVAIDAGHESFLFYKEGIYFEPDCSSEDMDHGVLVVGYGFESTESDNNKYWLVKNSWGEEWGMGGYVKMAKDRRNHCGIASAASYPTV

SEQ ID NO: 814743 - protein, 254 aa, Homo sapiens
MNPTLILAAFCLGIASATLTFDHSLEAQWTKWKAMHNRLYGMNEEGWRRAVWEKNMKMIELHNQEYREGKHSFTMAMNAFGDMTSEEFRQVMNGFQNRKPRKGKVFQEPLFYEAPRSVDWREKGYVTPVKNQGQCGSCWAFSATGALEGQMFRKTGRLISLSEQNLVDCSGPQGNEGCNGGLMDYAFQYVQDNGGLDSEESYPYEATVSGAPCHHSSSAFGRWTLSEITDTFFGIHILGLGGVAHACNPSPLGG

SEQ ID NO: 814744 - protein, 333 aa, Homo sapiens [sequence omitted]

SEQ ID NO: 814745 - protein, 333 aa, Homo sapiens [sequence omitted]

SEQ ID NO: 814746 - protein, 333 aa, Homo sapiens [sequence omitted]

SEQ ID NO: 814747 - protein, 333 aa, Homo sapiens [sequence omitted]

SEQ ID NO: 814748 - protein, 333 aa, Homo sapiens [sequence omitted]

SEQ ID NO: 814749 - protein, 299 aa, Homo sapiens [sequence omitted]

SEQ ID NO: 814750 - protein, 278 aa, Homo sapiens
MKMIELHNQEYREGKHSFTMAMNAFGDMTSEEFRQVMNGFQNRKPRKGKVFQEPLFYEAPRSVDWREKGYVTPVKNQGQCGSCWAFSATGALEGQMFRKTGRLISLSEQNLVDCSGPQGNEGCNGGLMDYAFQYVQDNGGLDSEESYPYEATEESCKYNPKYSVANDTGFVDIPKQEKALMKAVATVGPISVAIDAGHESFLFYKEGIYFEPDCSSEDMDHGVLVVGYGFESTESDNNKYWLVKNSWGEEWGMGGYVKMAKDRRNHCGIASAASYPTV

SEQ ID NO: 814751 - protein, 333 aa, Homo sapiens [sequence omitted]

SEQ ID NO: 814752 - protein, 366 aa, Homo sapiens
MNPTLILAAFCLGIASATLTFDHSLEAQWTKWKAMHNRLYGMNEEGWRRAVWEKNMKMIELHNQEYREGKHSFTMAMNAFGDMVSVLWTAELCASSLRFFTKVISCFSTFYFLFLKTSEEFRQVMNGFQNRKPRKGKVFQEPLFYEAPRSVDWREKGYVTPVKNQGQCGSCWAFSATGALEGQMFRKTGRLISLSEQNLVDCSGPQGNEGCNGGLMDYAFQYVQDNGGLDSEESYPYEATEESCKYNPKYSVANDTGFVDIPKQEKALMKAVATVGPISVAIDAGHESFLFYKEGIYFEPDCSSEDMDHGVLVVGYGFESTESDNNKYWLVKNSWGEEWGMGGYVKMAKDRRNHCGIASAASYPTV

SEQ ID NO: 814753 - protein, 339 aa, Homo sapiens
MNPTLILAAFCLGIASATLTFDHSLEAQWTKWKAMHNRLYGMNEEGWRRAVWEKNMKMIELHNQEYREGKHSFTMAMNAFGDMTSEEFRQVMNGFQNRKPRKGKVFQEPLFYEAPRSVDWREKGYVTPVKNQGQCGSCWAFSATGALEGQMFRKTGRLISLSEQNLVDCSGPQGNEGCNGGLMDYAFQYVQDNGGLDSEESYPYEATEESCKYNPKYSVANDTGFVDIPKQEKALMKAVATVGPISVAIDAGHESFLFYKEGIYFEPDCSSEDMDHGVLVVGYGFESTESDNNKYWLVKNRYKLPEILTFEIQKRILICKQCLDTVPHALSILLKSPEV

SEQ ID NO: 814754 - protein, 339 aa, Homo sapiens; identical to SEQ ID NO: 814753

SEQ ID NO: 814755 - protein, 315 aa, Homo sapiens
MNPTLILAAFCLGIASATLTFDHSLEAQWTKWKAMHNRLYGMNEEGWRRAVWEKNMKMIELHNQEYREGKHSFTMAMNAFGDMTSEEFRQVMNGFQNRKPRKGKVFQEPLFYEAPRSVDWREKGYVTPVKNQGQCGSCWAFSATGALEGQMFRPQGNEGCNGGLMDYAFQYVQDNGGLDSEESYPYEATEESCKYNPKYSVANDTGFVDIPKQEKALMKAVATVGPISVAIDAGHESFLFYKEGIYFEPDCSSEDMDHGVLVVGYGFESTESDNNKYWLVKNSWGEEWGMGGYVKMAKDRRNHCGIASAASYPTV

SEQ ID NO: 814756 - protein, 143 aa, Homo sapiens
TGHCGRQDIRNLSYEATEESCKYNPKYSVANDTGFVDIPKQEKALMKAVATVGPISVAIDAGHESFLFYKEGIYFEPDCSSEDMDHGVLVVGYGFESTESDNNKYWLVKNSWGEEWGMGGYVKMAKDRRNHCGIASAASYPTV

SEQ ID NO: 814757 - protein, 265 aa, Homo sapiens
MNPTLILAAFCLGIASATLTFDHSLEAQWTKWKAMHNRLYGMNEEGWRRAVWEKNMKMIELHNQEYREGKHSFTMAMNAFGDMTSEEFRQVMNGFQNRKPRKGKVFQEPLFYEAPRSVDWREKGYVTPVKNQGQCGSCWAFSATGALEGQMFRKTGRLISLSEQNLVDCSGPQGNEGCNGGLMDYAFQYVQDNGGLDSEESYPYEATEESCKYNPKYSVANDTGFVDIPKQEKALMKAVATVGTPAGKQSVTAGFPHLGNGYSCL

SEQ ID NO: 814758 - protein, 254 aa, Homo sapiens; identical to SEQ ID NO: 814743

SEQ ID NO: 814759 - protein, 167 aa, Homo sapiens
TSRGSYPFSHSMKPHLHPRLYHGCYGDIMTMKTSGATCDANSVMNCGIRGSEMFAEMDLRAIKPYQTLIKEVGQRHCVDPAVIAAIISRESHGGSVLQDGWDHRGLKFGLMQLDKQTYHPVGAWDSKEHLSQATGILTERIKAIQKKFPTWSVAQHLKGRLYSEYFV

SEQ ID NO: 814760 - protein, 115 aa, Homo sapiens
MFAEMDLRAIKPYQTLIKEVGQRHCVDPAVIAAIISRESHGGSVLQDGWDHRGLKFGLMQLDKQTYHPVGAWDSKEHLSQATGILTERIKAIQKKFPTWSVAQHLKGRLYSEYFV

SEQ ID NO: 814761 - protein, 387 aa, Homo sapiens
MEVLAAETTSQQERLQAIAEKRKRQAEIENKRRQLEDERRQLQHLKSKALRERWLLEGTPSSASEGDEDLRRQMQDDEQKTRLLEDSVSRLEKEIEVLERGDSAPAAAKENAAAPSPVRAPAPSPAKEERKTEVVMNSQQTPVGTPKDKRVSNTPLRTVDGSPMMKAAMYSVEITVEKDKVTGETRVLSSTTLLPRQPLPLGIKVYEDETKVVHAVDGTAENGIHPLSSSEVDELIHKADEVTLSEAGSTAGAAETRGAVEGAARTTPSRREITGVQAQPGEATSGPPGIQPGQEPPVTMIFMGYQNVEDEAETKKVLGLQDTITAELVVIEDAAEPKEPAPPNGSAAEPPTEAASREENQAGPEATTSDPQDLDMKKHRCKCCSIM

SEQ ID NO: 814762 - protein, 142 aa, Homo sapiens
RRQMQDDEQKTRLLEDSVSGWRRKLSVLEMEVLAAETTSQQERLQAIAEKRKRQAEIENKRRQLEDERRQLQHLKSKALRERWLLEGTPSSASEGDEDLRRQMQDDEQKTPPQPLPRRTRRPRAQSGPQPRVQPRRSARQRW

SEQ ID NO: 814763 - protein, 470 aa, Homo sapiens
WALPTPTPRTAEASAGLPSGLGLMNSSPGAGLSHALQTTPSPGPEPPTPPHAVKSIAGTGGLCAPGWASGGGRGAPGLCAAAGSQGGSETQHLPRDPQHLPWDPQQHQDRRRPELFHAFARDSAPPPSMVLAAETTSQQERLQAIAEKRKRQAEIENKRRQLEDERRQLQHLKSKALRERWLLEGTPSSASEGDEDLRRQMQDDEQKTRLLEDSVSRLEKEIEVLERGDSAPAAAKENAAAPSPVRAPAPSPAKEERKTEVVMNSQQTPVGTPKDKRVSNTPLRTVDGSPMMKAVVHAVDGTAENGIHPLSSSEVDELIHKADEVTLSEAGSTAGAAETRGAVEGAARTTPSRREITGVQAQPGEATSGPPGIQPGQEPPVTMIFMGYQNVEDEAETKKVLGLQDTITAELVVIEDAAEPKEPAPPNGSAAEPPTEAASREENQAGPEATTSDPQDLDMKKHRCKCCSIM

SEQ ID NO: 814764 - protein, 470 aa, Homo sapiens; identical to SEQ ID NO: 814763

SEQ ID NO: 814765 - protein, 227 aa, Homo sapiens
MGASARLLRAVIMGAPGSGKGTVSSRITTHFELKHLSSGDLLRDNMLRGTEIGVLAKAFIDQGKLIPDDVMTRLALHELKNLTQYSWLLDGFPRTLPQAEALDRAYQIDTVINLNVPFEVIKQRLTARWIHPASGRVYNIEFNPPKTVGIDDLTGEPLIQREDDKPETVIKRLKAYEDQTKPVLEYYQKKGVLETFSGTETNKIWPYVYAFLQTKVPQRSQKASVTP

SEQ ID NO: 814766 - protein, 157 aa, Homo sapiens
MTRLALHELKNLTQYSWLLDGFPRTLPQAEALDRAYQIDTVINLNVPFEVIKQRLTARWIHPASGRVYNIEFNPPKTVGIDDLTGEPLIQREDDKPETVIKRLKAYEDQTKPVLEYYQKKGVLETFSGTETNKIWPYVYAFLQTKVPQRSQKASVTP

SEQ ID NO: 814767 - protein, 191 aa, Homo sapiens
MGASARLLRAVIMGAPGSGKGTVSSRITTHFELKHLSSGDLLRDNMLRGTEIGVLAKAFIDQGKLIPDDVMTRLALHELKNLTQYSWLLDGFPRTLPQAEALDRAYQIDTVINLNVPFEVIKQRLTARWIHPASGRVYNIEFNPPKTVGIDDLTGEPLIQREDDKPETVIKRLKAYEDQTKPVLEYYQKGC

SEQ ID NO: 814768 - protein, 107 aa, Homo sapiens
MGASARLLRAVIMGAPGSGKGTVSSRITTHFELKHLSSGDLLRDNMLRGTASLFPENNNIEIRPTNNPTVASEVFKLKEESGTSLTLNQKLEMIKLSEEGMLKTKTG

SEQ ID NO: 814769 - protein, 227 aa, Homo sapiens; identical to SEQ ID NO: 814765

SEQ ID NO: 814770 - protein, 227 aa, Homo sapiens; identical to SEQ ID NO: 814765

SEQ ID NO: 814771 - protein, 227 aa, Homo sapiens; identical to SEQ ID NO: 814765

SEQ ID NO: 814772 - protein, 227 aa, Homo sapiens; identical to SEQ ID NO: 814765

SEQ ID NO: 814773 - protein, 227 aa, Homo sapiens; identical to SEQ ID NO: 814765

SEQ ID NO: 814774 - protein, 157 aa, Homo sapiens; identical to SEQ ID NO: 814766

SEQ ID NO: 814775 - protein, 157 aa, Homo sapiens; identical to SEQ ID NO: 814766

SEQ ID NO: 814776 - protein, 227 aa, Homo sapiens; identical to SEQ ID NO: 814765

SEQ ID NO: 814777 - protein, 227 aa, Homo sapiens; identical to SEQ ID NO: 814765

SEQ ID NO: 814778 - protein, 337 aa, Homo sapiens
MNSTCIEEQHDLDHYLFPIVYIFVIIVSIPANIGSLCVSFLQAKKESELGIYLFSLSLSDLLYALTLPLWIDYTWNKDNWTFSPALCKGSAFLMYMNFYSSTAFLTCIAVDRYLAVVYPLKFFFLRTRRFALMVSLSIWILETIFNAVMLWEDETVVEYCDAEKSNFTLCYDKYPLEKWQINLNLFRTCTGYAIPLVTILICNRKVYQAVRHNKATENKEKKRIIKLLVSITVTFVLCFTPFHVMLLIRCILEHAVNFEDHSNSGKRTYTMYRITVALTSLNCVADPILYCFVTETGRYDMWNILKFCTGRCNTSQRQRKRILSVSTKDTMELEVLE

SEQ ID NO: 814779 - protein, 242 aa, Homo sapiens
MNFYSSTAFLTCIAVDRYLAVVYPLKFFFLRTRRFALMVSLSIWILETIFNAVMLWEDETVVEYCDAEKSNFTLCYDKYPLEKWQINLNLFRTCTGYAIPLVTILICNRKVYQAVRHNKATENKEKKRIIKLLVSITVTFVLCFTPFHVMLLIRCILEHAVNFEDHSNSGKRTYTMYRITVALTSLNCVADPILYCFVTETGRYDMWNILKFCTGRCNTSQRQRKRILSVSTKDTMELEVLE

SEQ ID NO: 814780 - protein, 238 aa, Homo sapiens
MNSTCIEEQHDLDHYLFPIVYIFVIIVSIPANIGSLCVSFLQAKKESELGIYLFSLSLSDLLYALTLPLWIDYTWNKDNWTFSPALCKGSAFLMYMNFYSSTAFLTCIAVDRYLAVVYPLKFFFLRTRRFALMVSLSIWILETIFNAVMLWEDETVVEYCDAEKSNFTLCYDKYPLEKWQINLNLFRTCTGYAIPLVTILICNRKVYQAVRHNKATENKEKKRILNLFGNKKNLWVIG

SEQ ID NO: 814781 - protein, 276 aa, Homo sapiens
EGKKFVPRGFSYFASAVYTYIQSRFYRSPEVILGHPYDVAIDMWSLGCITAELYTGYPLFPGENEVEQLACIMEVLGLPPAGFIQTASRRQTFFDSKGFPKNITNNRGKKRYPDSKDLTMVLKTYDTSFLDFLRRCLVWEPSLRMTPDQALKHAWIHQSRNLKPQPRPQTLRKSNSFFPSETRKDKVQGCHHSSRKADEITKETTEKTKDSPTKHVQHSGDQQDCLQHGADTVQLPQLVDAPKKSEAAVGAEVSMTSPGQSKNFSLKNTNVLPPIV

SEQ ID NO: 814782 - protein, 165 aa, Homo sapiens
ARYEAVLIGRGRVVRVLSMSRSAITAIATSVCHGPPCRQLHHALMPHGKGGRSSVSGIVATVFGATGFLGRYVVNHLGRMGSQVIIPYRCDKYDIMHLRPMGDLGQLLFLEWDARDKDSIRRVVQHSNVVINLIGRDWETKNFDFEDVFVKIPQAMCSTVQGSWS

SEQ ID NO: 814783 - protein, 125 aa, Homo sapiens
MTQMDAKKPRKCDLTPFLVLKARKKQKFTSAKGPTLSEIYMVGSKLSVQIQKPPSNIKNSRMTQVFHKNTSVTSLPFVDTKGKKNTVSFPHISKKVLLKSSLLYQVSADGLDPEKAGERPGFSPK

SEQ ID NO: 814784 - protein, 179 aa, Homo sapiens
SLAAVVSRECCRGGLWEKMAAAAQSRVVRVLSMSRSAITAIATSVCHGPPCRQLHHALMPHGKGGRSSVSGIVATVFGATGFLGRYVVNHLGRMGSQVIIPYRCDKYDIMHLRPMGDLGQLLFLEWDARDKDSIRRVVQHSNVVINLIGRDWETKNFDFEDVFVKIPQAMCSTVQGSWS

SEQ ID NO: 814785 - protein, 179 aa, Homo sapiens; identical to SEQ ID NO: 814784

SEQ ID NO: 814786 - protein, 179 aa, Homo sapiens; identical to SEQ ID NO: 814784

SEQ ID NO: 814787 - protein, 179 aa, Homo sapiens; identical to SEQ ID NO: 814784

SEQ ID NO: 814788 - protein, 179 aa, Homo sapiens; identical to SEQ ID NO: 814784

SEQ ID NO: 814789 - protein, 179 aa, Homo sapiens; identical to SEQ ID NO: 814784

SEQ ID NO: 814790 - protein, 179 aa, Homo sapiens; identical to SEQ ID NO: 814784

SEQ ID NO: 814791 - protein, 179 aa, Homo sapiens; identical to SEQ ID NO: 814784

SEQ ID NO: 814792 - protein, 179 aa, Homo sapiens; identical to SEQ ID NO: 814784

SEQ ID NO: 814793 - protein, 179 aa, Homo sapiens; identical to SEQ ID NO: 814784

SEQ ID NO: 814794 - protein, 218 aa, Homo sapiens
STRGGYSRSAMYSRKAMYKRKYSAAKSKVEKKKKEKVLATVTKPVGGDKNGGTRDRQMAAAAQSRVVRVLSMSRSAITAIATSVCHGPPCRQLHHALMPHGKGGRSSVSGIVATVFGATGFLGRYVVNHLGRMGSQVIIPYRCDKYDIMHLRPMGDLGQLLFLEWDARDKDSIRRVVQHSNVVINLIGRDWETKNFDFEDVFVKIPQAMCSTVQGSWS

SEQ ID NO: 814795 - protein, 179 aa, Homo sapiens; identical to SEQ ID NO: 814784

SEQ ID NO: 814796 - protein, 179 aa, Homo sapiens; identical to SEQ ID NO: 814784

SEQ ID NO: 814797 - protein, 483 aa, Homo sapiens
MPASELKASEIPFHPSIKTQDPKAEEKSPKKQKVTLTAAEALKLFKNQLSPYEQSEILGYAELWFLGLEAKKLDTAPEKFSKTSFDDEHGFYLKVLHDHIAYRYEVLETIGKGSFGQVAKCLDHKNNELVALKIIRNKKRFHQQALMELKILEALRKKDKDNTYNVVHMKDFFYFRNHFCITFELLGINLYELMKNNNFQGFSLSIVRRFTLSVLKCLQMLSVEKIIHCDLKPENIVLYQKGQASVKVIDFGSSCYEHQKVYTYIQSRFYRSPEVILGHPYDVAIDMWSLGCITAELYTGYPLFPGENEVEQLACIMELTNKDVCAHMEGEVLLDVRTGSAITAIATSVCHGPPCRQLHHALMPHGKGGRSSVSGIVATVFGATGFLGRYVVNHLGRMGSQVIIPYRCDKYDIMHLRPMGDLGQLLFLEWDARDKDSIRRVVQHSNVVINLIGRDWETKNFDFEDVFVKIPQAMCSTVQGSWS

SEQ ID NO: 814798 - protein, 158 aa, Homo sapiens [sequence omitted]

SEQ ID NO: 814799 - protein, 158 aa, Homo sapiens [sequence omitted]

SEQ ID NO: 814800 - protein, 158 aa, Homo sapiens [sequence omitted]

SEQ ID NO: 814801 - protein, 179 aa, Homo sapiens; identical to SEQ ID NO: 814784

SEQ ID NO: 814802 - protein, 179 aa, Homo sapiens; identical to SEQ ID NO: 814784

SEQ ID NO: 814803 - protein, 158 aa, Homo sapiens [sequence omitted]

SEQ ID NO: 814804 - protein, 520 aa, Homo sapiens
MPASELKASEIPFHPSIKTQDPKAEEKSPKKQKVTLTAAEALKLFKNQLSPYEQSEILGYAELWFLGLEAKKLDTAPEKFSKTSFDDEHGFYLKVLHDHIAYRYEVLETIGKGSFGQVAKCLDHKNNELVALKIIRNKKRFHQQALMELKILEALRKKDKDNTYNVVHMKDFFYFRNHFCITFELLGINLYELMKNNNFQGFSLSIVRRFTLSVLKCLQMLSVEKIIHCDLKPENIVLYQKGQASVKVIDFGSSCYEHQKVYTYIQSRFYRSPEVILGHPYDVAIDMWSLGCITAELYTGYPLFPGENEVEQLACIMEVLGLPPAGFIQTASRRQTFFDSKGFPKNITNNRGKKRYPDSKDLTMVLKTYDTSFLDFLRRCLVWEPSLRMTPDQALKHAWIHQSRNLKPQPRPQTLRKSNSFFPSETRKDKVQGCHHSSRKADEITKETTEKTKDSPTKHVQHSGDQQDCLQHGADTVQLPQLVDAPKKSEAAVGAEVSMTSPGQSKNFSLKNTNVLPPIV

SEQ ID NO: 814805 - protein, 326 aa, Homo sapiens [sequence omitted]

SEQ ID NO: 814806 - protein, 234 aa, Homo sapiens
MWSLGCITAELYTGYPLFPGENEVEQLACIMEVLGLPPAGFIQTASRRQTFFDSKGFPKNITNNRGKKRYPDSKDLTMVLKTYDTSFLDFLRRCLVWEPSLRMTPDQALKHAWIHQSRNLKPQPRPQTLRKSNSFFPSETRKDKVQGCHHSSRKADEITKETTEKTKDSPTKHVQHSGDQQDCLQHGADTVQLPQLVDAPKKSEAAVGAEVSMTSPGQSKNFSLKNTNVLPPIV

SEQ ID NO: 814807 - protein, 157 aa, Homo sapiens
MVLKTYDTSFLDFLRRCLVWEPSLRMTPDQALKHAWIHQSRNLKPQPRPQTLRKSNSFFPSETRKDKVQGCHHSSRKADEITKETTEKTKDSPTKHVQHSGDQQDCLQHGADTVQLPQLVDAPKKSEAAVGAEVSMTSPGQSKNFSLKNTNVLPPIV

SEQ ID NO: 814808 - protein, 326 aa, Homo sapiens [sequence omitted]

SEQ ID NO: 814809 - protein, 271 aa, Homo sapiens
SLAAVVSRECCRGGLWEKMAAAAQSRVVRVLSMSRSAITAIATSVCHGPPCRQLHHALMPHGKGGRSSVSGIVATVFGATGFLGRYVVNHLGRMGSQVIIPYRCDKYDIMHLRPMGDLGQLLFLEWDARDKDSIRRVVQHSNVVIFSILLGREEPWGKKNQKKKKLFWEIFFGNGGGTHEGYHINQRRAVFGGKHTTANIFFSPTPPRPQKRKGAAPTTKLFCLGGRRFSPQKKTLLSVGGGCFLPHPQKKDQGGGGANTNKNAGAPLFLV

SEQ ID NO: 814810 - protein, 459 aa, Homo sapiens
MPASELKASEIPFHPSIKTQDPKAEEKSPKKQKVTLTAAEALKLFKNQLSPYEQSEILGYAELWFLGLEAKKLDTAPEKFSKTSFDDEHGFYLKVLHDHIAYRYEVLETIGKGSFGQVAKCLDHKNNELVALKIIRNKKRFHQQALMELKILEALRKKDKDNTYNVVHMKDFFYFRNHFCITFELLGINLYELMKNNNFQGFSLSIVRRFTLSVLKCLQMLSVEKIIHCDLKPENIVLYQKGQASVKVIDFGSSCYEHQKVYTYIQSRFYRSPEVILGHPYDVAIDMWSLGCITAELYTGYPLFPGENEVEQLACIMEVLGLPPAGFIQTASRRQTFFDSKGFPKNITNNRGKKRYPDSKDLTMVLKTYDTSFLDFLRRCLVWEPSLRMTPDQALKHAWIHQSRNLKPQPRPQTLRKSNSFFPSETRKDKVQGCHHSSRKAGTACQITSPSPTVRELIF

SEQ ID NO: 814811 - protein, 131 aa, Homo sapiens
SLAAVVSRECCRGGLWEKMAAAAQSRVVRVLSMSRSAITAIATSVCHGPPCRQLHHALMPHGKGGRSSVSGIVATVFGATGFLGRYVVNHLGRMGSQVIIPYRCDKYDIMHLRPMGDLGQLLFLVRAFMTE

SEQ ID NO: 814812 - protein, 326 aa, Homo sapiens [sequence omitted]

SEQ ID NO: 814813 - protein, 154 aa, Homo sapiens
MTQMDAKKPRKCDLTPFLVLKARKKQKFTSAKGPTLSEIYMVGSKLSVQIQKPPSNIKNSRMTQVFHKNTSVTSLPFVDTKGKKNTVSFPHISKKVLLKSSLLYQENQAHNQMPASELKASEIPFHPSIKTQDPKAEEKSPKKQKVTLTAAGPS

SEQ ID NO: 814814 - protein, 397 aa, Homo sapiens
MRNATSALGPELRCLGAAVHPDPEHSQAKVSLACVGRRLVCGARRAVEKSERIRMEAVATATAAKEPDKGCIEPGPGHWGELSRTPVPSKPQDKVEAAEATPVALDSDTSGAENAAVSAMLHAVAASRLPVCSQQQGEPDLTEHEKVAILAQLYHEKPLVFLERFRTGLREEHLACFGHVRGDHRADFYCAEVARQGTARPRTLRTRLRNRRYAALRELIQGGEYFSDEQMRFRAPLLYEQYIGQYLTQEELSARTPTHQPPKPGSPGRPACPLSNLLLQSYEERELQQRLLQQQEEEEACLEEEEEEEDSDEEDQRSGKDSEAWVPDSEERLILREEFTSRMHQRFLDGKDGDFDYSTVDDNPDFDNLDIVARDEEERYFDEEEPEDAPSPELDGD

SEQ ID NO: 814815 - protein, 278 aa, Homo sapiens
MLHAVAASRLPVCSQQQGEPDLTEHEKVAILAQLYHEKPLVFLERFRTGLREEHLACFGHVRGDHRADFYCAEVARQGTARPRTLRTRLRNRRYAALRELIQGGEYFSDEQMRFRAPLLYEQYIGQYLTQEELSARTPTHQPPKPGSPGRPACPLSNLLLQSYEERELQQRLLQQQEEEEACLEEEEEEEDSDEEDQRSGKDSEAWVPDSEERLILREEFTSRMHQRFLDGKDGDFDYSTVDDNPDFDNLDIVARDEEERYFDEEEPEDAPSPELDGD

SEQ ID NO: 814816 - protein, 397 aa, Homo sapiens; identical to SEQ ID NO: 814814

SEQ ID NO: 814817 - protein, 397 aa, Homo sapiens; identical to SEQ ID NO: 814814

SEQ ID NO: 814818 - protein, 109 aa, Homo sapiens [sequence omitted]

SEQ ID NO: 814819 - protein, 397 aa, Homo sapiens; identical to SEQ ID NO: 814814

SEQ ID NO: 814820 - protein, 385 aa, Homo sapiens
MRNATSALGPELRCLGAAVHPDPEHSQAKVSLACVGRRLVCGARRAVEKSERIRMEAVATATAAKEPDKGCIEPGPGHWGELSRTPVPSKPQDKVEAAEATPVALDSDTSGAENAAVSAMLHAVAASRLPVCSQQQGEPDLTEHEKVAILAQLYHEKPLVFLERFRTGLREEHLACFGHVRGDHRADFYCAEVARQGTARPRTLRTRLRNRRYAALRELIQGGEYFSDEQMRFRAPLLYEQYIGQYLTQEELSARTPTHQPPKPGSPGRPACPLSNLLLQSYEERELQQRLLQQQEEEEACLEEEEEEEDSDEEDQRSGKDSEAWVPDSEERLILREEFTSRMHQRFLDGKDGDFDYSTVDDNPDFDNLDIVARDEEEMSSDGKV

SEQ ID NO: 814821 - protein, 428 aa, Homo sapiens
MRNATSALGPELRCLGAAVHPDPEHSQAKVSLACVGRRLVCGARRAVEKSERIRMEAVATATAAKEPDKGCIEPGPGHWGELSRTPVPSKPQDKVEAAEATPVALDSDTSGAENAAVSAMLHAVAASRLPVCSQQQGEPDLTEHEKVAILAQLYHEKPLVFLERFRTGLREEHLACFGHVRGDHRADFYCAEVARQGTARPRTLRTRLRNRRYAALRELIQGGEYFSDEQMRFRAPLLYEQYIGQYLTQEELSARTPTHQPPKPGSPGRPACPLSNLLLQSYEERELQQRLLQQQEEEEACLEEEEEEEDSDEEDQRSGKDSEAWVPDSEERLILREEFTSRMHQRFLDGKDGDFDYRCSCASTSPSPSPASHGLWSHAEPLTSCGGLPLWSYKAPKQFQDVGLNSQRKRLGDLGLALSISDPQSPHL

SEQ ID NO: 814822 - protein, 138 aa, Homo sapiens
MNSLVSWQLLLFLCATHFGEPLEKVASVGNSRPTGQQLESLGLLAPGEQSLPCTERKPAATARLSRRGTSLSPPPESSGSPQQPGLSAPHSRQIPAPQGAVLVQREKDLPNYNWNSFGLRFGKREAAPGNHGRSAGRG

SEQ ID NO: 814823 - protein, 138 aa, Homo sapiens; identical to SEQ ID NO: 814822

SEQ ID NO: 814824 - protein, 138 aa, Homo sapiens; identical to SEQ ID NO: 814822

SEQ ID NO: 814825 - protein, 138 aa, Homo sapiens; identical to SEQ ID NO: 814822

SEQ ID NO: 814826 - protein, 138 aa, Homo sapiens; identical to SEQ ID NO: 814822

SEQ ID NO: 814827 - protein, 138 aa, Homo sapiens; identical to SEQ ID NO: 814822

SEQ ID NO: 814828 - protein, 158 aa, Homo sapiens
MNSLVSWQLLLFLCATHFGEPLEKVASVGNSRPTGQQLESLGLLAPGEQSLPCTERKPAATARLSRRGTSLSPPPESSGSPQQPGLSAPHSRQIPAPQGAVLVQREKDLPNYNWNSFGLRFGKREAAPGNHGRRRLESRRLGIAGNYTNTHKERYKKK

SEQ ID NO: 814829 - protein, 108 aa, Homo sapiens
MNSLVSWQLLLFLCATHFGEPLEKVASVGNSRPTGQQLESLGLLAPGEQSLPCTERKPAATARLSRRGTSLSPPPESSGSPQQPGLSAPHSRQIPAPQGAVLVHAGRG

SEQ ID NO: 814830 - protein, 52 aa, Homo sapiens
MNSLVSWQLLLFLCATHFGEPLEKVASVGNSRPTGQQLDHWPPAPDEPAFRT

SEQ ID NO: 814831 - protein, 138 aa, Homo sapiens; identical to SEQ ID NO: 814822

SEQ ID NO: 814832 - protein, 1080 aa, Homo sapiens
SSVPHPVRPSDGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASSSTLSSAKTFMSLVKSLSTEVEPKESPHPARHRHLMKTLVKSLSTDTSRQESDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGCRPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREVTLVHVTDWIEKKLEQEFQKVFVMPNMDDVYITIMHSAMDPRSTSCLLKDPPVEAADQP

SEQ ID NO: 814833 - protein, 1127 aa, Homo sapiens
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASSSTLSSAKTFMSLVKSLSTEVEPKESPHPARHRHLMKTLVKSLSTDTSRQESDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGCRPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREVTLVHVTDWIEKKLEQEFQKVFVMPNMDDVYITIMHSAMDPRSTSCLLKDPPVEAADQP

SEQ ID NO: 814834 - protein, 1127 aa, Homo sapiens; identical to SEQ ID NO: 814833

SEQ ID NO: 814835 - protein, 1108 aa, Homo sapiens
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASSSTLSSAKTFMSLVKSLSTEVEPKESPHPARHRHLMKTLVKSLSTDTSRQESDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGCRPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREKVFVMPNMDDVYITIMHSAMDPRSTSCLLKDPPVEAADQP

SEQ ID NO: 814836 - protein, 1127 aa, Homo sapiens; identical to SEQ ID NO: 814833

SEQ ID NO: 814837 - protein, 1127 aa, Homo sapiens; identical to SEQ ID NO: 814833

SEQ ID NO: 814838 - protein, 1127 aa, Homo sapiens; identical to SEQ ID NO: 814833

SEQ ID NO: 814839 - protein, 1052 aa, Homo sapiens
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASSSTLSSAKTFMSLVKSLSTEVEPKESPHPARHRHLMKTLVKSLSTDTSRQESDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGCRPRAFCLADSDEESSSAGSSEEDDAPEPSGGDKQLLPGAEGYVGGHRTSKIMRFVDKITKSKYFQKATETEFIKKKIEEVSNADAPSLADIAGEEAHFRSNSGLHIPPKHLETEWP

SEQ ID NO: 814840 - protein, 767 aa, Homo sapiens
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASSSTLSSAKTFMSLVKSLSTEVEPKESPHPARHRHLMKTLVKSLSTDTSRQESDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPGLLPAHSRHNSPSGHLTHSRSSSKGSVEEIMSESTCPGHWSL

SEQ ID NO: 814841 - protein, 1127 aa, Homo sapiens; identical to SEQ ID NO: 814833

SEQ ID NO: 814842 - protein, 927 aa, Homo sapiens
MYEGGPCFNFRYRELAFHLSLLGRRCQHKSDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGCRPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREVTLVHVTDWIEKKLEQEFQKVFVMPNMDDVYITIMHSAMDPRSTSCLLKDPPVEAADQP

SEQ ID NO: 814843 - protein, 1127 aa, Homo sapiens; identical to SEQ ID NO: 814833

SEQ ID NO: 814844 - protein, 1127 aa, Homo sapiens; identical to SEQ ID NO: 814833

SEQ ID NO: 814845 - protein, 201 aa, Homo sapiens
VVVTLSLSSCRPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREVTLVHVTDWIEKKLEQEFQKVFVMPNMDDVYITIMHSAMDPRSTSCLLKDPPVEAADQP

SEQ ID NO: 814846 - protein, 1127 aa, Homo sapiens; identical to SEQ ID NO: 814833

SEQ ID NO: 814847 - protein, 893 aa, Homo sapiens
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASSSTLSSAKTFMSLVKSLSTEVEPKESPHPARHRHLMKTLVKSLSTDTSRQESDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGNS

SEQ ID NO: 814848 - protein, 84 aa, Homo sapiens
MNPCFCAFLVLCLFFLSLLDSQLHNLIALQVTCFKDVEIPNFFCDPSQLSHLACCDTFTINIIMYFPAAIFGFLPILGTLFSFS

SEQ ID NO: 814849 - protein, 148 aa, Homo sapiens
MSTLSGRPFSSLLLEQGDHRGATWLGRGGGAGPGQSGPGHGQGTATPGPGQVRAAQARARRGGGARDAAAEGAREPGAGRRGARAGPGAHLRAGEPSEPALRRPSSAERPLAAGVLLPQMQAEPRSHGQPFRQLQSHWQAPRQGWPAQ

SEQ ID NO: 814850 - protein, 109 aa, Homo sapiens
FLKLLLENCPKHIFLTFVGPLAHQNLQNLYIRRRTDSSLMNQKKISGWSWYLHTQCIFLKLYGEVMGDLYYSEFSKVLWLLHPSKIKIKFVAVLKSSSSCLLYSFLGLL

SEQ ID NO: 814851 - protein, 78 aa, Homo sapiens
WWRGRRKCGVLAGGCFLWAGCGRLPRWGPGRDGCSGGRGWERALGGPGEAVPAGAAEFLHLQPALLAAGRRGCSESYN

SEQ ID NO: 814852 - protein, 84 aa, Homo sapiens; identical to SEQ ID NO: 814848

SEQ ID NO: 814853 - protein, 140 aa, Homo sapiens
NSRPRRHDRRAGPKMAASRYRRFLKLCEEWPVDETKRGRDLGAYLRQRVAQAFREGENTQVAEPEACDQMYESLARLHSNYYKHKYPRPRDTSFSGLSLEEYKLILSTDTLEELKEIDKGMWKKLQEKFAPKGPEEDHKA

SEQ ID NO: 814854 - protein, 250 aa, Homo sapiens [sequence omitted]

SEQ ID NO: 814855 - protein, 102 aa, Homo sapiens
EQPTGDFSLLEKLEQEGNLSGKVAEPEACDQMYESLARLHSNYYKHKYPRPRDTSFSGLSLEEYKLILSTDTLEELKEIDKGMWKKLQEKFAPKGPEEDHKA

SEQ ID NO: 814856 - protein, 98 aa, Homo sapiens
YKKRLKQTIAPARVGCPYVAEPEACDQMYESLARLHSNYYKHKYPRPRDTSFSGLSLEEYKLILSTDTLEELKEIDKGMWKKLQEKFAPKGPEEDHKA

SEQ ID NO: 814857 - protein, 86 aa, Homo sapiens
FVGLDCYLTTCATELCRVESYATPFNYYFIKYPRPRDTSFSGLSLEEYKLILSTDTLEELKEIDKGMWKKLQEKFAPKGPEEDHKA

SEQ ID NO: 814858 - protein, 250 aa, Homo sapiens [sequence omitted]

SEQ ID NO: 814859 - protein, 221 aa, Homo sapiens
MMGSDSGPRPSPSQCLLNSTACAESTHQDSNPCSTSQLCNLSKLLHCLLPQFPHLKTGDRKGCVEQAKFCDEASGSVGCTADSAGPFLCPHTEQGNEQHIPALMPRVRRGQETTDSVLGTESGTQCSVPASGHFCYLFDLLFRSWVSTFFRNTLCEKQAMLVSGKPSGSNLCHQVLDFSPSLFLSSPFADTLEELKEIDKGMWKKLQEKFAPKGPEEDHKA

SEQ ID NO: 814860 - protein, 153 aa, Homo sapiens
MSSSMGITWELVRNAESGAPPIPAFSREDSRVHYSWSCLLETVLVLARPSLDLEVALLFSLLGLLALVAQGLGEMQLESRACVLISPLPSLPFCPGDQYPRPRDTSFSGLSLEEYKLILSTDTLEELKEIDKGMWKKLQEKFAPKGPEEDHKA

SEQ ID NO: 814861 - protein, 250 aa, Homo sapiens [sequence omitted]

SEQ ID NO: 814862 - protein, 203 aa, Homo sapiens
HPVTCIYMQIYWFMQNSGGLGGGFFSLKLVQSLKKRRKAVSGVLHVRLAPGSWAGSRRTKTELARLAEKGEQRPYTESSGAPTKSRMPTPASRSTPKAGGEAECASAIRRRRLLPLRREHAGPKMAASRYRRFLKLCEEWPVDETKRGRDLGAYLRQRVAQAFREGENTQVAEPEACDQMYESLARLHSNYYKHKTPWKSLRK

SEQ ID NO: 814863 - protein, 140 aa, Homo sapiens
MSRFLNVLRSWLVMVSIIAMGNTLQSFRDHTFLYEKLYTGKPNLVNGLQARTFGIWTLLSSVIRCLCAIDIHNKTLYHITLWTFLLALGHFLSELFVYGTAAPTIGVLAPLMVASFSILGMLVGLRYLEVEPVSRQKKRN

SEQ ID NO: 814864 - protein, 140 aa, Homo sapiens; identical to SEQ ID NO: 814863

SEQ ID NO: 814865 - protein, 140 aa, Homo sapiens; identical to SEQ ID NO: 814863

SEQ ID NO: 814866 - protein, 177 aa, Homo sapiens
METAQSWSRAEGGGGDKWLRWTPGWSCPGGACLRQRLLLPLLCWGPGRQAKSPPTFEGNTLQSFRDHTFLYEKLYTGKPNLVNGLQARTFGIWTLLSSVIRCLCAIDIHNKTLYHITLWTFLLALGHFLSELFVYGTAAPTIGVLAPLMVASFSILGMLVGLRYLEVEPVSRQKKRN

SEQ ID NO: 814867 - protein, 110 aa, Homo sapiens
HVATRTSILPSQQRVNGLQARTFGIWTLLSSVIRCLCAIDIHNKTLYHITLWTFLLALGHFLSELFVYGTAAPTIGVLAPLMVASFSILGMLVGLRYLEVEPVSRQKKRN

SEQ ID NO: 814868 - protein, 122 aa, Homo sapiens
MSRFLNVLRSWLVMVSIIAMGNTLQSFRDHTFLYVGIWTLLSSVIRCLCAIDIHNKTLYHITLWTFLLALGHFLSELFVYGTAAPTIGVLAPLMVASFSILGMLVGLRYLEVEPVSRQKKRN

SEQ ID NO: 814869 - protein, 137 aa, Homo sapiens
SDEKKNMNWKQLPKKPCKNLLSTLKKLYPQLSSVHQKTQEGSAIDMTPIEADFSWQKKMTQLEMEIQEAFLRFMASILKGYRTYLRPITEAPSNKATAADSLFDRQDDLSISVAMPIYFPFGPLFTGLQCLVHLYHL

SEQ ID NO: 814870 - protein, 314 aa, Homo sapiens
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPKAGLLIIVLAIIAREGDCAPEEKIWEELSVLEVFEGREDSILGDPKKLLTQHFVQENYLEYRQVPGSDPACYEFLWGPRALVETSYVKVLHHMVKISGGPHISYPPLHEWVLREGEE

SEQ ID NO: 814871 - protein, 314 aa, Homo sapiens; identical to SEQ ID NO: 814870

SEQ ID NO: 814872 - protein, 314 aa, Homo sapiens; identical to SEQ ID NO: 814870

SEQ ID NO: 814873 - protein, 730 aa, Homo sapiens
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 814874 - protein, 691 aa, Homo sapiens
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 814875 - protein, 610 aa, Homo sapiens
MEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 814876 - protein, 571 aa, Homo sapiens
MEESMKKAAEVLNKHSLSGRPLKVKEDPDGEHARRAMQKAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 814877 - protein, 425 aa, Homo sapiens
MGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 814878 - protein, 453 aa, Homo sapiens
TIFLRSVWTKLLQQLRPSRLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 814879 - protein, 592 aa, Homo sapiens
MEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 814880 - protein, 577 aa, Homo sapiens
MEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMEGPFGGGMENMGRFGSGMNMGRINGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 814881 - protein, 301 aa, Homo sapiens
MEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINAGSKRRRRWRRRRSKWRKRAARPACRAATGLRALRVKENDLLRMRRGR

SEQ ID NO: 814882 - protein, 685 aa, Homo sapiens
RPRLLLPRAILLWSGGEEEPPRRPRARSCEPEEAARTPGFPPSRGSRGAKGSPGRGTREPRPPRGAPLRVPCTMSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKLCPFNIPPSASPSPSCLCLTLCCSQRPPVSQAAKGTPLPPLQRVHDLQTQNPLLQEPKAWVGATPEDFSNLPPEQRRKKLQQKVDELNKEIQKEMDQRDAITKMKDVYLKNPQMGDPASLDHKLAEVSQNIEKLRVETQKFEAWLAEVEGRLPARNEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 814883 - protein, 533 aa, Homo sapiens
MNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKLCPFNIPPSASPSPSCLCLTLCCSQRPPVSQAAKGTPLPPLQRVHDLQTQNPLLQEPKAWVGATPEDFSNLPPEQRRKKLQQKVDELNKEIQKEMDQRDAITKMKDVYLKNPQMGDPASLDHKLAEVSQNIEKLRVETQKFEAWLAEVEGRLPARNEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 814884 - protein, 176 aa, Homo sapiens
MDQRDAITKMKDVYLKNPQMGDPASLDHKLAEVSQAWLAEVEGRLPARNEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 814885 - protein, 201 aa, Homo sapiens [sequence omitted]

SEQ ID NO: 814886 - protein, 689 aa, Homo sapiens
RPRLLLPRAILLWSGGEEEPPRRPRARSCEPEEAARTPGFPPSRGSRGAKGSPGRGTREPRPPRGAPLRVPCTMSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKLCPFNIPPSASPSPSCLCLTLCCSQRPPVSQAAKGTPLPPLQRVHDLQTQNPLLQEPKAWVGATPEDFSNLPPEQRRKKLQQKVDELNKEIQKEMDQRDAITKMKDVYLKNPQMGDPASLDHKLAEVSQNIEKLRVETQKFEAWLAEVEGRLPARNEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKGAKTYI

SEQ ID NO: 814887 - protein, 685 aa, Homo sapiens; identical to SEQ ID NO: 814882

SEQ ID NO: 814888 - protein, 685 aa, Homo sapiens; identical to SEQ ID NO: 814882

SEQ ID NO: 814889 - protein, 685 aa, Homo sapiens; identical to SEQ ID NO: 814882

SEQ ID NO: 814890 - protein, 484 aa, Homo sapiens
RPRLLLPRAILLWSGGEEEPPRRPRARSCEPEEAARTPGFPPSRGSRGAKGSPGRGTREPRPPRGAPLRVPCTMSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKLCPFNIPPSASPSPSCLCLTLCCSQRPPVSQAAKGTPLPPLQRVHDLQTQNPLLQEPKAWGKFCSGILSLWRALVACLVLHN

SEQ ID NO: 814891 - protein, 211 aa, Homo sapiens
RPRLLLPRAILLWSGGEEEPPRRPRARSCEPEEAARTPGFPPSRGSRGAKGSPGRGTREPRPPRGAPLRVPCTMSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSVSKTLFFFFLKDGPNTVGISLED

SEQ ID NO: 814892 - protein, 75 aa, Homo sapiens
MALGWSLSLLLSPGAWLAEVEGRLPARNEQARRQSGLYDSQNPPTVNNCAQDRERYSICTAPASGKGACWLCIYF

SEQ ID NO: 814893 - protein, 685 aa, Homo sapiens; identical to SEQ ID NO: 814882

SEQ ID NO: 814894 - protein, 665 aa, Homo sapiens
MQNARLEPAPSSLTESFSFCFSLCCRFLEGSACEPRVSLPGGASVCLFPQASSALPCGQPTPPQPHPCGAVSLSLSSMLPAALPSRPARATSWGTSLASAHPHGSGQSSSLPLPTPRRPLRRWDTRPHLLLPGPSVHPGSSWQPFRASHSAFCESVITGPLRRQGGPAHIRRTEHSMSSVSMSSVCPRLPAVENTSSSPESVKSSVVLFGFYGLHLILNIDPFTMPSTWEHLAGRGAGTHTPTGTPTSTHACAYTHFGLTPCFQWPGEVHTGSRIPARLVDSPVSTGHEEPTPVLPITFLSLRTVDHALVSEALPSAPAHCKANILSFPGAPGLASEKGSTSFFVVVFFFFLRRESRSIVQTGVHGMISAHYNLHLLGSSDSPASASQIAVITGVHHHARLMFVFLVETGFHRVGQAGLKLLTSGDPPASASQSAEITGVSYRTPPRLALSSPKTPCLSWSFEGSRRHHPCILSRALQGMWNSLSLLLEPSFFPCVGFEENLRSPNLWPPPPPRRHALEQSSPSSHLVQKQSRGTIGLELLGPRAPRKPGDDVGQLYSLLGFGELGGPLKHPQFLLLFMNLRQGSPIEAKGTGTERTGPKGWGCLYLWKPGNCSSQPTKVDHTPPFRSSSVSPRGRETTSAETLRPRQVKRKWLWVFKVGEREPL

SEQ ID NO: 814895 - protein, 120 aa, Homo sapiens
FKYDHKNFMFELNHLIITQYIGTSGTNIYFVNIYVLLTSPHQPPPPPPASASPSAVPNGPQSPKQQKEPLSHRFNEFMTSKPKIHCFRSLKRGVSSAPESCLSGVLWLHVWFCITNFVCE

SEQ ID NO: 814896 - protein, 625 aa, Homo sapiens
RPRLLLPRAILLWSGGEEEPPRRPRARSCEPEEAARTPGFPPSRGSRGAKGSPGRGTREPRPPRGAPLRVPCTMSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKLGATPEDFSNLPPEQRRKKLQQKVDELNKEIQKEMDQRDAITKMKDVYLKNPQMGDPASLDHKLAEVSQNIEKLRVETQKFEAWLAEVEGRLPARNEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 814897 - protein, 533 aa, Homo sapiens; identical to SEQ ID NO: 814883

SEQ ID NO: 814898 - protein, 431 aa, Homo sapiens
MAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKLCPFNIPPSASPSPSCLCLTLCCSQRPPVSQAAKGTPLPPLQRVHDLQTQNPLLQEPKAWVGATPEDFSNLPPEQRRKKLQQKVDELNKEIQKEMDQRDAITKMKDVYLKNPQMGDPASLDHKLAEVSQNIEKLRVETQKFEAWLAEVEGRLPARNEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 814899 - protein, 309 aa, Homo sapiens
MLIFVLCLLVSDFYSVTAPSLTCSLCLCPFNIPPSASPSPSCLCLTLCCSQRPPVSQAAKGTPLPPLQRVHDLQTQNPLLQEPKAWVGATPEDFSNLPPEQRRKKLQQKVDELNKEIQKEMDQRDAITKMKDVYLKNPQMGDPASLDHKLAEVSQNIEKLRVETQKFEAWLAEVEGRLPARNEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 814900 - protein, 441 aa, Homo sapiens
KSAVSLTLLSSLSETPCMSPYGWTPQQLLGHCVVMVPILKSIFEGQVQYTCAYTHTHTHTHTHTHTHTRGSESGRLCAPGILERRPAHTLAGLCTSFTKAYKSGFEPPGDIEFEDYTQPMKRTVSDNSLSNSRGEGKPDLKFGGKSKGKLWPFIKKNKLCPFNIPPSASPSPSCLCLTLCCSQRPPVSQAAKGTPLPPLQRVHDLQTQNPLLQEPKAWVGATPEDFSNLPPEQRRKKLQQKVDELNKEIQKEMDQRDAITKMKDVYLKNPQMGDPASLDHKLAEVSQNIEKLRVETQKFEAWLAEVEGRLPARNEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 814901 - protein, 685 aa, Homo sapiens; identical to SEQ ID NO: 814882

SEQ ID NO: 814902 - protein, 689 aa, Homo sapiens; identical to SEQ ID NO: 814886

SEQ ID NO: 814903 - protein, 661 aa, Homo sapiens
RPRLLLPRAILLWSGGEEEPPRRPRARSCEPEEAARTPGFPPSRGSRGAKGSPGRGTREPRPPRGAPLRVPCTMSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKSPKQQKEPLSHRFNEFMTSKPKIHCFRSLKRGLGATPEDFSNLPPEQRRKKLQQKVDELNKEIQKEMDQRDAITKMKDVYLKNPQMGDPASLDHKLAEVSQNIEKLRVETQKFEAWLAEVEGRLPARNEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKGAKTYI

SEQ ID NO: 814904 - protein, 502 aa, Homo sapiens
RPRLLLPRAILLWSGGEEEPPRRPRARSCEPEEAARTPGFPPSRGSRGAKGSPGRGTREPRPPRGAPLRVPCTMSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKLCPFNIPPSASPSPSCLCLTLCCSQRPPVSQAAKGTPLPPLQRVHDLQTQNPLLQEPKAWVGATPEDFSNLPPEQRRKKLQQKVDELNKEIQKEMDQRSE

SEQ ID NO: 814905 - protein, 482 aa, Homo sapiens
RPRLLLPRAILLWSGGEEEPPRRPRARSCEPEEAARTPGFPPSRGSRGAKGSPGRGTREPRPPRGAPLRVPCTMSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKTQSFCFHKELMKRTIGKPTYAFEARDYVVSSPVMARSYSHGTATNPIHSTKTGDPEALVMLPHYEMKFLIERTGHQEKKK

SEQ ID NO: 814906 - protein, 123 aa, Homo sapiens
PGHFCAEGDGFEAVGEGSVHLRRSEWGEFCVDFIFDDTCFIAKATVCFLPAFAKNLTYPDIAFSGQNEGTISVVEGETLYVIEEDKGDGWTRIRRNEDEEGYVPTSYVEVCLDKNAKGAKTYI

SEQ ID NO: 814907 - protein, 628 aa, Homo sapiens
SGLCVRVCVQRRWRRGQVGARSCCFWFSCGRRRCPAALGCRTDKAWATAPQKPTQLDAGAGRRVGDRVSEGAARAGGRAPEGERGGGGGSAAGRAGRGMSMPDAMPLPGVGEELKQAKEIEDAEKYSFMATVTKAPKKQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 814908 - protein, 628 aa, Homo sapiens; identical to SEQ ID NO: 814907

SEQ ID NO: 814909 - protein, 628 aa, Homo sapiens; identical to SEQ ID NO: 814907

SEQ ID NO: 814910 - protein, 628 aa, Homo sapiens; identical to SEQ ID NO: 814907

SEQ ID NO: 814911 - protein, 628 aa, Homo sapiens; identical to SEQ ID NO: 814907

SEQ ID NO: 814912 - protein, 628 aa, Homo sapiens; identical to SEQ ID NO: 814907

SEQ ID NO: 814913 - protein, 483 aa, Homo sapiens
MQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 814914 - protein, 483 aa, Homo sapiens; identical to SEQ ID NO: 814913

SEQ ID NO: 814915 - protein, 567 aa, Homo sapiens
KRALRACLRTAEVAARAGRSSELLLLVLLWPPSLSGCLGLPNRQGVGHSTSEADAARRRGRQEGGRSRVGGRRAGRRQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 814916 - protein, 545 aa, Homo sapiens
SGLCVRVCVQRRWRRGQVGARSCCFWFSCGRRRCPAALGCRTDKAWATAPQKPTQQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 814917 - protein, 603 aa, Homo sapiens
SGLCVRVCVQRRWRRGQVGARSCCFWFSCGRRRCPAALGCRTDKAWATAPQKPTQLDAGAGRRVGDRVSEGAARAGGRAPEGERGGGGGSAAGRAGRGMSMPDAMPLPGVGEELKQAKEIEDAEKYSFMATVTKAPKKQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDTNGPYYQGPVHLNHTL

SEQ ID NO: 814918 - protein, 605 aa, Homo sapiens
SGLCVRVCVQRRWRRGQVGARSCCFWFSCGRRRCPAALGCRTDKAWATAPQKPTQLDAGAGRRVGDRVSEGAARAGGRAPEGERGGGGGSAAGRAGRGMSMPDAMPLPGVGEELKQAKEIEDAEKYSFMATVTKAPKKQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEALALIELYNAPEGRYKQDVYLLPKKMDEYVASLHLPSFDAHLTELTDDQAKYLGLNKNGPFKPNYYRY

SEQ ID NO: 814919 - protein, 550 aa, Homo sapiens
MVDVLTRIPAAMWFGYRMLMTRAQVNESVVHDSQKVTSVQWSIAHLKVARSNAKSRFADNIAGEFHRRFSLPKYVVAHVLLDHRSISQSSYLTATSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 814920 - protein, 470 aa, Homo sapiens
MARFSDDPLSDMPTGVTSASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 814921 - protein, 480 aa, Homo sapiens
SGLCVRVCVQRRWRRGQVGARSCCFWFSCGRRRCPAALGCRTDKAWATAPQKPTQLDAGAGRRVGDRVSEGAARAGGRAPEGERGGGGGSAAGRAGRGMSMPDAMPLPGVGEELKQAKEIEDAEKYSFMATVTKAPKKQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGFGTDRTL

SEQ ID NO: 814922 - protein, 79 aa, Homo sapiens
MPLESETELIPGLSLTFPGSSTQFELLHSSHLCSVHHSHNTGMWQNACLHCTAICGTGRRSVPVRVYCTMFSSSYSFLM

SEQ ID NO: 814923 - protein, 152 aa, Homo sapiens
NSSAKTAEEVIYYMVVTLRPQINTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 814924 - protein, 628 aa, Homo sapiens; identical to SEQ ID NO: 814907

SEQ ID NO: 814925 - protein, 330 aa, Homo sapiens
SGLCVRVCVQRRWRRGQVGARSCCFWFSCGRRRCPAALGCRTDKAWATAPQKPTQLDAGAGRRVGDRVSEGAARAGGRAPEGERGGGGGSAAGRAGRGMSMPDAMPLPGVGEELKQAKEIEDAEKYSFMATVTKAPKKQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDHVYNEHGLLRSGGPLGFIV

SEQ ID NO: 814926 - protein, 588 aa, Homo sapiens
SGLCVRVCVQRRWRRGQVGARSCCFWFSCGRRRCPAALGCRTDKAWATAPQKPTQLDAGAGRRVGDRVSEGAARAGGRAPEGERGGGGGSAAGRAGRGMSMPDAMPLPGVGEELKQAKEIEDAEKYSFMATVTKAPKKQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMGE

SEQ ID NO: 814927 - protein, 513 aa, Homo sapiens
SGLCVRVCVQRRWRRGQVGARSCCFWFSCGRRRCPAALGCRTDKAWATAPQKPTQLDAGAGRRVGDRVSEGAARAGGRAPEGERGGGGGSAAGRAGRGMSMPDAMPLPGVGEELKQAKEIEDAEKYSFMATVTKAPKKQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVVRLLSFVAR

SEQ ID NO: 814928 - protein, 438 aa, Homo sapiens
SGLCVRVCVQRRWRRGQVGARSCCFWFSCGRRRCPAALGCRTDKAWATAPQKPTQLDAGAGRRVGDRVSEGAARAGGRAPEGERGGGGGSAAGRAGRGMSMPDAMPLPGVGEELKQAKEIEDAEKYSFMATVTKAPKKQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVNSWVSVSLSFCVLIRNIG

SEQ ID NO: 814929 - protein, 221 aa, Homo sapiens
MQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEVLDLVVTGLYSLFPL

SEQ ID NO: 814930 - protein, 649 aa, Homo sapiens [sequence omitted]

SEQ ID NO: 814931 - protein, 237 aa, Homo sapiens
MAGVSFSGHRLELLAAYEEVIREESAADWALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKRREEELPDRKKEPEKRELKGSRFRSKEGLERNRQGAKGSPEAGAYRGGEATK

SEQ ID NO: 814932 - protein, 82 aa, Homo sapiens
ERRQEEQSIFGDHRDEEEETHMKKSESEVEEAAAIIAQRPDNPREFFKQQERVAIRNQPPRVFLLNGRFWRWPGRSRFPEPL

SEQ ID NO: 814933 - protein, 649 aa, Homo sapiens [sequence omitted]

SEQ ID NO: 814934 - protein, 649 aa, Homo sapiens [sequence omitted]

SEQ ID NO: 814935 - protein, 743 aa, Homo sapiens
PLPRPLARSARDAAEAPRRRRRLPLSLPPPPSARPSARLSVRPGPARSMAGVSFSGHRLELLAAYEEVIREESAADWALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRRKQQTLEAEEAKRRLKEQSIFGDHRDEEEETHMKKSESEVEEAAAIIAQRPDNPREFFKQQERVASASAGSCDVPSPFNHRPGRPYCPFIKASDSGPSSSSSSSSSPPRTPFPYITCHRTPNLSSSLPCSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEVHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGEPLAAPQTPTLPSALEELEQEQEPEPHLLTNGETTQKEGTQASEGYFSQSQEEEFAQSEELCAKAPPPVFYNKPPEIDITCWDADPVPEEEEGFEGGD

SEQ ID NO: 814936 - protein, 854 aa, Homo sapiens
GGRTRPGGAGSRCGARGRVALREPIPHPTPRARGTGVHGAAKGTFATFERARSGRGRGGDRASGASAACPAQPGPATAQRKARAGEERSGLGAGRPAHRGASRSGPPSPRNLGWSEVEGCLLPHGDREVTPLPPRVAEEAGGRCPSGSRPPLPAGRWEQVLLEETEAKRRAGLRDPAWAGLTRTLGGQPGGDSDLGASGGEDEMAGHPWHGTAALASSQAWRDGRERQALVSCRALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRRKQQTLEAEEAKRRLKEQSIFGDHRDEEEETHMKKSESEVEEAAAIIAQRPDNPREFFKQQERVASASAGSCDVPSPFNHRPGSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEVHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGEPLAAPQTPTLPSALEELEQEQEPEPHLLTNGETTQKEGTQASEGYFSQSQEEEFAQSEELCAKAPPPVFYNKPPEIDITCWDADPVPEEEEGFEGGD

SEQ ID NO: 814937 - protein, 722 aa, Homo sapiens
PLPRPLARSARDAAEAPRRRRRLPLSLPPPPSARPSARLSVRPGPARSMAGVSFSGHRLELLAAYEEVIREESAADWALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRLSLPARSAPGAPGRTLTGAGCLSSRRKQQTLEAEEAKRRLKEQSIFGDHRDEEEETHMKKSESEVEEAAAIIAQRPDNPREFFKQQERVASASAGSCDVPSPFNHRPGSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEVHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGEPLAAPQTPTLPSALEELEQEQEPEPHLLTNGETTQKEGTQASEGYFSQSQEEEFAQSEELCAKAPPPVFYNKPPEIDITCWDADPVPEEEEGFEGGD

SEQ ID NO: 814938 - protein, 761 aa, Homo sapiens
GGRTRPGGAGSRCGARGRVALREPIPHPTPRARGTGVHGAAKGTFATFERARSGRGRGGDRASGASAACPAQPGPATAQRKARAGEERSGLGAGRPAHRGASRSGPPSPRNLGWSEVEGCLLPHGDREVTPLPPRVAEEEGALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRRKQQTLEAEEAKRRLKEQSIFGDHRDEEEETHMKKSESEVEEAAAIIAQRPDNPREFFKQQERVASASAGSCDVPSPFNHRPGSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEVHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGEPLAAPQTPTLPSALEELEQEQEPEPHLLTNGETTQKEGTQASEGYFSQSQEEEFAQSEELCAKAPPPVFYNKPPEIDITCWDADPVPEEEEGFEGGD

SEQ ID NO: 814939 - protein, 336 aa, Homo sapiens
MAGVSFSGHRLELLAAYEEVIREESAADWALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRRKQQTLEAEEAKRRLKEQSIFGDHRDEEEETHMKKSESEVEEAAAIIAQRPDNPREFFKQQERVASASAGSCDVPSPFNHRPAELQLAPTQGRAAGGKAC

SEQ ID NO: 814940 - protein, 551 aa, Homo sapiens
MAGVSFSGHRLELLAAYEEVIREESAADWALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKQQERVASASAGSCDVPSPFNHRPGSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEVHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGEPLAAPQTPTLPSALEELEQEQEPEPHLLTNGETTQKEGTQASEGYFSQSQEEEFAQSEELCAKAPPPVFYNKPPEIDITCWDADPVPEEEEGFEGGD

SEQ ID NO: 814941 - protein, 570 aa, Homo sapiens
MNRTPVKEVLLVGCAHVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHSVSLPARSAPGAPGRTLTGAGCLSSRRKQQTLEAEEAKRRLKEQSIFGDHRDEEEETHMKKSESEVEEAAAIIAQRPDNPREFFKQQERVASASAGSCDVPSPFNHRPGSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEVHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGEPLAAPQTPTLPSALEELEQEQEPEPHLLTNGETTQKEGTQASEGYFSQSQEEEFAQSEELCAKAPPPVFYNKPPEIDITCWDADPVPEEEEGFEGGD

SEQ ID NO: 814942 - protein, 251 aa, Homo sapiens
MAGVSFSGHRLELLAAYEEVIREESAADWALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRRTPADFRSGRGMRRV

SEQ ID NO: 814943 - protein, 122 aa, Homo sapiens
MARPPRRRGPRPVRGTSVNHRRRSLPNRKSSVPRLRLLCSTTSLQRSTSHAGMQTQFQKRRRASRVVISGGASPRLPLPRPPTCISLWPDGPPCLHSQQLRLAPTPDSGPGWGLGRFPTHRA

SEQ ID NO: 814944 - protein, 241 aa, Homo sapiens
PLPRPLARSARDAAEAPRRRRRLPLSLPPPPSARPSARLSVRPGPARSMAGVSFSGHRLELLAAYEEVIREESAADWALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKRPRSPAPS

SEQ ID NO: 814945 - protein, 604 aa, Homo sapiens
MMKSQGLVSFKDVAVDFTQEEWQQLDPSQRTLYRDVMLENYSHLVSMGYPVSKPDVISKLEQGEEPWIIKGDISNWIYPDEYQADGRQDRKSNLHNSQSCILGTVSFHHKILKGVTRDGSLCSILKVCQGDGQLQRFLENQDKLFRQVTFVNSKTVTEASGHKYNPLGKIFQECIETDISIQRFHKYDAFKKNLKPNIDLPSCYKSNSRKKPDQSFGGGKSSSQSEPNSNLEKIHNGVIPFDDNQCGNVFRNTQSLIQYQNVETKEKSCVCVTCGKAFAKKSQLIVHQRIHTGKKPYDCGACGKAFSEKFHLVVHQRTHTGEKPYDCSECGKAFSQKSSLIIHQRVHTGEKPYECSECGKAFSQKSPLIIHQRIHTGEKPYECRECGKAFSQKSQLIIHHRAHTGEKPYECTECGKAFCEKSHLIIHKRIHTGEKPYKCAQCEEAFSRKTELITHQLVHTGEKPYECTECGKTFSRKSQLIIHQRTHTGEKPYKCSECGKAFCQKSHLIGHQRIHTGEKPYICTECGKAFSQKSHLPGHQRIHTGEKPYICAECGKAFSQKSDLVLHQRIHTGERPYQCAICGKAFIQKSQLTVHQRIHTVVKS

SEQ ID NO: 814946 - protein, 183 aa, Homo sapiens
EFRNRHRPAAMKRLVDIAAISKLEQGEEPWIIKGDISNWIYPDEYQADGRQDRKSNLHNSQSCILGTVSFHHKILKGVTRDGSLCSILKVCQGDGQLQRFLENQDKLFRQVTFVNSKTVTEASGHKYNPLGKIFQECIETDISIQRFHKYDAFKKNLKPNIDLPSCYKSQRESLAMLTRLVLN

SEQ ID NO: 814947 - protein, 604 aa, Homo sapiens; identical to SEQ ID NO: 814945

SEQ ID NO: 814948 - protein, 604 aa, Homo sapiens; identical to SEQ ID NO: 814945

SEQ ID NO: 814949 - protein, 604 aa, Homo sapiens; identical to SEQ ID NO: 814945

SEQ ID NO: 814950 - protein, 974 aa, Homo sapiens
MEERKHETMNPAHVLFDRFVQATTCKGTLKAFQELCDHLELKPKDYRSFYHKLKSKLNYWKAKALWAKLDKRGSHKDYKKGKACTMSHHWGWPLWSPYSHRLILTGGQGGCYEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATAGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQLTQERGASQPSCCLPGQVRPAPTPRWKQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSGVNGLEEPSIAKRLRGTPERIELENYRLSLRQAEALQEVPEETQAEHNLSSVLDTGAEEDVASRSARRAAGRPPATRP

SEQ ID NO: 814951 - protein, 946 aa, Homo sapiens
MEERKHETMNPAHVLFDRFVQATTCKGTLKAFQELCDHLELKPKDYRSFYHKLKSKLNYWKAKALWAKLDKRGSHKDYKKGKACTMSHHWGWPLWSPYSHRLILTGGQGGCYEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATAGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSGVNGLEEPSIAKRLRGTPERIELENYRLSLRQAEALQEVPEETQAEHNLSSVLDTGAEEDVASRSARRAAGRPPATRP

SEQ ID NO: 814952 - protein, 573 aa, Homo sapiens
VTTAPGFVNFLNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSGVNGLEEPSIAKRLRGTPERIELENYRLSLRQAEALQEVPEETQAEHNLSSVLDTGAEEDVASRSARRAAGRPPATRP

SEQ ID NO: 814953 - protein, 524 aa, Homo sapiens
MFMVLVPILSILLCYCRESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSGVNGLEEPSIAKRLRGTPERIELENYRLSLRQAEALQEVPEETQAEHNLSSVLDTGAEEDVASRSARRAAGRPPATRP

SEQ ID NO: 814954 - protein, 947 aa, Homo sapiens
MEERKHETMNPAHVLFDRFVQATTCKGTLKAFQELCDHLELKPKDYRSFYHKLKSKLNYWKAKALWAKLDKRGSHKDYKKGKACTMSHHWGWPLWSPYSHRLILTGGQGGCYEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATAGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSLTSLFGWVARHSLGLCDKAKGMSQHLQSNISSFGQQVAQNPLDSFFMCQLLAFGVPFLYGLSEVLVQIRGEFHWQAVAQ

SEQ ID NO: 814955 - protein, 966 aa, Homo sapiens
MEERKHETMNPAHVLFDRFVQATTCKGTLKAFQELCDHLELKPKDYRSFYHKLKSKLNYWKAKALWAKLDKRGSHKDYKKGKACTMSHHWGWPLWSPYSHRLILTGGQGGCYEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATAGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSGVNGLEEPSIAKRLRGTPERIELENYRLSLRQAEALQEVPEETQAEHNLSSVLDTGAEEDVASSLLERATDSLRVNLGGVREFTRLSIFQVNIACFPS

SEQ ID NO: 814956 - protein, 515 aa, Homo sapiens
MEERKHETMNPAHVLFDRFVQATTCKGTLKAFQELCDHLELKPKDYRSFYHKLKSKLNYWKAKALWAKLDKRGSHKDYKKGKAALCLIIGAGPCGLRTAIDLSLLGAKVVVIEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATAGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRPSCQYLHLGPSAVSHHHGIIAFQPGQQSKTSS

SEQ ID NO: 814957 - protein, 161 aa, Homo sapiens
MEERKHETMNPAHVLFDRFVQATTCKGTLKAFQELCDHLELKPKDYRSFYHKLKSKLNYWKAKALWAKLDKRGSHKDYKKGKACTTGIDLENIVYYKDDTHYFVMTAKKQSLLDKGVILHVSHGFPSKLFLIEVVNITKRKNCLMGFSCKGMKMSTECIFW

SEQ ID NO: 814958 - protein, 107 aa, Homo sapiens
SIPTLLFLWRQDYADTELLLSRENVDQEALLSYAREAADFSTQQQLPSLDFAINHYGQPDVAMFDFTCMYASENAALVREQNGHQLLVALVGDSLLEVSAKHGSTLW

SEQ ID NO: 814959 - protein, 135 aa, Homo sapiens [sequence omitted]

SEQ ID NO: 814960 - protein, 367 aa, Homo sapiens
MSSTLAKIAEIEAEMARTQKNKATAHHLGLLKARLAKLRRELITPKGGGGGGPGEGFDVAKTGDARIGFVGFPSVGKSTLLSNLAGVYSEVAAYEFTTLTTVPGVIRYKGAKIQLLDLPGIIEGAKDGKGRGRQVIAVARTCNLILIVLDVLKPLGHKKIIENELEGFGIRLNSKPPNIGFKKKDKGGINLTATCPQSELDAETVKSILAEYKIHNADVTLRSDATADDLIDVVEGNRVYIPCIYVLNKIDQISIEELDIIYKVPHCVPISAHHRWNFDDLLEKIWDYLKLVRIYTKPKGQLPDYTSPVVLPYSRTTVEDFCMKIHKNLIKEFKYALVWGLSVKHNPQKVGKDHTLEDEDVIQIVKK

SEQ ID NO: 814961 - protein, 367 aa, Homo sapiens; identical to SEQ ID NO: 814960

SEQ ID NO: 814962 - protein, 168 aa, Homo sapiens
MSSTLAKIAEIEAEMARTQKNKATAHHLGLLKARLAKLRRELITPKGGGGGGPGEGFDVAKTGDARIGFVGFPSVGKSTLLSNLAGVYSEVAAYEFTTLTTVPGVIRYKGAKIQLLDLPGIIEGAKDGKGRGRQVIAVARTCNLILIVLDVLKPLGHKKIIENEDREA

SEQ ID NO: 814963 - protein, 326 aa, Homo sapiens
MSSTLAKIAEIEAEMARTQKNKATAHHLGLLKARLAKLRRELITPKGGGGGGPGEGFDVAKTGDARIGFVGFPSVGKSTLLSNLAGVYSEVAAYEFTTLTTVPGVIRYKGAKIQLLDLPGIIEGAKDGKGRGRQVIAVARTCNLILIVLDVLKPLGHKKIIENELEGFGIRLNSKPPNIGFKKKDKGGINLTATCPQSELDAETVKSILAEYKIHNADVTLRSDATADDLIDVVEGNRVYIPCIYVLNKIDQISIEELDIIYKVPHCVPISAHHRWNFDDLLEKIWDYLKLVRIYTKPKGQLPDYTSPQTGTSFVLPWCHLVCRTA

SEQ ID NO: 814964 - protein, 343 aa, Homo sapiens
MIGRLAWLLSDKDILLQTCECCEELSSATQEGFDVAKTGDARIGFVGFPSVGKSTLLSNLAGVYSEVAAYEFTTLTTVPGVIRYKGAKIQLLDLPGIIEGAKDGKGRGRQVIAVARTCNLILIVLDVLKPLGHKKIIENELEGFGIRLNSKPPNIGFKKKDKGGINLTATCPQSELDAETVKSILAEYKIHNADVTLRSDATADDLIDVVEGNRVYIPCIYVLNKIDQISIEELDIIYKVPHCVPISAHHRWNFDDLLEKIWDYLKLVRIYTKPKGQLPDYTSPVVLPYSRTTVEDFCMKIHKNLIKEFKYALVWGLSVKHNPQKVGKDHTLEDEDVIQIVKK

SEQ ID NO: 814965 - protein, 397 aa, Homo sapiens
MSSTLAKIAEIEAEMARTQKNKATAHHLGLLKARLAKLRRELITPKGGGGGGPGEGFDVAKTGDARIGFVGFPSVGKSTLLSNLAGVYSEVAAYEFTTLTTVPGVIRYKGAKIQLLDLPGIIEGAKDGKGRGRQVIAVARTCNLILIVLDVLKPLGHKKIIENELEGFGIRLNSKPPNIGFKKKDKGGINLTATKRRFAMLPRLVLNFGLSCLLLRSPKVLGLQCPQSELDAETVKSILAEYKIHNADVTLRSDATADDLIDVVEGNRVYIPCIYVLNKIDQISIEELDIIYKVPHCVPISAHHRWNFDDLLEKIWDYLKLVRIYTKPKGQLPDYTSPVVLPYSRTTVEDFCMKIHKNLIKEFKYALVWGLSVKHNPQKVGKDHTLEDEDVIQIVKK

SEQ ID NO: 814966 - protein, 177 aa, Homo sapiens
MGLQCPQSELDAETVKSILAEYKIHNADVTLRSDATADDLIDVVEGNRVYIPCIYVLNKIDQISIEELDIIYKVPHCVPISAHHRWNFDDLLEKIWDYLKLVRIYTKPKGQLPDYTSPVVLPYSRTTVEDFCMKIHKNLIKEFKYALVWGLSVKHNPQKVGKDHTLEDEDVIQIVKK

SEQ ID NO: 814967 - protein, 164 aa, Homo sapiens
MSSTLAKIAEIEAEMARTQKNKATAHHLGLLKARLAKLRRELITPKGGGGGGPGEGFDVAKTGDARIGFVGFPSVGKSTLLSNLAGVYSEVAAYEFTTLTTVPGVIRYKGAKIQLLDLPGIIEGAKDGKGRGRQVIAVARTCNLILIVLDVLKPLGHKKIIENE

SEQ ID NO: 814968 - protein, 1248 aa, Homo sapiens
MLFRTTFWSLADFPLTPENNSSLKNGNLNVCGNGLVDFFENKLEKVTYNHPFRICKATGKPLINDNQQSSVLICILNAELLGLYKQHEWFLETFKIVSKLVPKWHIIIIHFLFARKSAHRVHSQILNELTLNSFFMLKNNRTNNNTIFGQNPPYLMRTIACAQYLEMHTLHISPHFQLGLPFFARRSYPSLFRLIFYPFLKYKVLRVSEIQDILAQLTQVLYSSLHRPLAAEILFLSSGFTGFSSWVPPKLGETKAFSENLKARLTSDSDSSILHLMYFNSWVLWSVQRPWVRYIHLQYLIGITFLSSLEYSSSHSPNLTTFRFSLPGLPGEVDNLLVVEAPMNVSRDILRGKFLLIDNQDNQVVTQSSLSREHLSFSPLLQLLISGPWNKTIVPKIEHPKSSCLVETADFFDSLAAKPEIDHYGDRMFASIPTKQVKTEVKIILLLNLKSKKNHNVIFFLNPLILYTKLIITEKNDLNKKQLRLKPKTAVTPSPMSVSHHNTVSLTVLEMLNREGIQCFIEAKSQGVSAAEYLFVQIENLRRQRGQGEVFSSSEFRILRQPSYLYLENAFSPDNKTVHIWRHQPLVPNSLSSRCIPLPLYHSISQGNHQHQPAKCLYLKSLPFLKLTFYEALSFLRDLSLVVVVSFTKKNNRCNWSHFAVFKIFFLSAWLERRLEYLVFEYLNYFQLFILILSDEMQVVKNRLYSFLFEFVTSNHCFYSYTTTVLQMAHREAGYYIGKQEFIHWVPELNLENTFGMSFHTFSLKSHPNLWLHIFLSFPPSFTFWKVNSFLNPKCYKSLGEIFPQNLVKKVPHSHLLQVIISCNSFNAMEKLQLLTSQENFSRKIPATFPLSSLSSTIIKTWARSPLTSHSGKAMCCHKKTTSFGVRPEFEFQLNHVGFMVGALSVSISTLVNWGNDTYFKGFLGGLNEVYKFLASGLGLSKYSRNVQFSSSMFLFYSSNGIIETMGQNIFLYSKDCMTEFALEKKNCIKSLIQLYINYITLIQYMVVNSETLPVCLLLSIELVFSFSWLSSCLLILSHMLPSLLVPSSLLYFTRFGTCSPLDFFFNILAFPRCNIFTSLLVKLDISHDLEREEIWNDLISFNYLMLMNACIIVNKGELKILISTFCPQISVSISTRQESAGCMMPFEAASHQTEILITVHEVKQTEFNGNTFCIGPVLKGGKYKFSNKKSLLLLGAVAHTCEYQQFEKLRQVDHLRPGVRDQPGQHSETPSLLKIQEKLAGHGGARL

SEQ ID NO: 814969 - protein, 1251 aa, Homo sapiens
MLFRTTFWSLADFPLTPENNSSLKNGNLNVCGNGLVDFFENKLEKVTYNHPFRICKATGKPLINDNQQSSVLICILNAELLGLYKQHEWFLETFKIVSKLVPKWHIIIIHFLFARKSAHRVHSQILNELTLNSFFMLKNNRTNNNTIFGQNPPYLMRTIACAQYLEMHTLHISPHFQLGLPFFARRSYPSLFRLIFYPFLKYKVLRVSEIQDILAQLTQVLYSSLHRPLAAEILFLSSGFTGFSSWVPPKLGETKAFSENLKARLTSDSDSSILHLMYFNSWVLWSVQRPWVRYIHLQYLIGITFLSSLEYSSSHSPNLTTFRFSLPGLPGEVDNLLVVEAPMNVSRDILRGKFLLIDNQDNQVVTQSSLSREHLSFSPLLQLLISGPWNKTIVPKIEHPKSSCLVETADFFDSLAAKPEIDHYGDRMFASIPTKQVKTEVKIILLLNLKSKKNHNVIFFLNPLILYTKLIITEKNDLNKKQLRLVSLTVLEMLNREGIQCFIEAKSQGVSAAEYLFVQIENLRRQRGQGEVFSSSEFRILRQPSYLYLENAFSPDNKTVHIWRHQPLVPNSLSSRCIPLPLYHSISQGNHQHQPAKCLYLKSLPFLKLTFYEALSFLRDLSLVVVVSFTKKNNRCNWSHFAVFKIFFLSAWLERRLEYLVFEYLNYFQLFILILSDEMQVVKNRLYSFLFEFVTSNHCFYSYTTTVLQMAHREAGYYIGKQEFIHWVPELNLENTFGMSFHTFSLKSHPNLWLHIFLSFPPSFTFWKVNSFLNPKCYKSLGEIFPQNLVKKVPHSHLLQVIISCNSFNGMEKLQLLTSQENFSRKIPATFPLSSLSSTIIKTWARSPLTSHSGKAMCCHKKTTSFGVRPEFEFQLNHVGFMVGALSVSISTLVNWGNDTYFKGFLGGLNEVYKFLASGLGLSKYSRNVQFSSSMFLFYSSNGIIETMGQNIFLYSKDCMTEFALEKKNCIKSLIQLYINYITLIQYMVVNSETLPVCLLLSIELVFSFSWLSSCLLILSHMLPSLLVPSSLLYFTRFGTCSPLDFFFNILAFPRCNIFTSLLVKLDISHDLEREEIWNDLISFNYLMLMNACIIVNKGELKILISTFCPQISVSISTRQESAGCMMPFEAASHQTEILITVHKMKQTEFNGNTFCIGPVLKGGKYKFSNKKSLLLLGAVAHTCEYQQFEKLRQVDHLRPGVRDQPGQHSETPSLLKIKKISWAWWCTPIVPATQEAEAGESLEPGKQSLQ

SEQ ID NO: 814970 - protein, 1303 aa, Homo sapiens
MSESAEDAVYPISLLYHLNDILKVRGKGKCRHNKHCYFSLCLGKEAESYILSMLFRTTFWSLADFPLTPENNSSLKNGNLNVCGNGLVDFFENKLEKVTYNHPFRICKATGKPLINDNQQSSVLICILNAELLGLYKQHEWFLETFKIVSKLVPKWHIIIIHFLFARKSAHRVHSQILNELTLNSFFMLKNNRTNNNTIFGQNPPYLMRTFACAQYLEMHTLHISPHFQLGLPFFARRSYPSLFRLIFYPFLKYKVLRVSEIQDILAQLTQVLYSSLHRPLAAEILFLSSGFTGFSSWVPPYLGETKAFSENLKARLTSDSDSSILHLMYFNSWVLWSVQRPWVRYIHLQYLIGITFLSSLEYSSSHSPNLTTFRFSLPGLPGEVDNLLVVEAPMNVSRDILRGKFLLIDNQDNQVVTQSSLSREHLSFSPLLQLLISGPWNKTIVPKIEHPKSSCLVETADFFDSLAAKPEIDHQVTECLPVSPQNKLKLEVKIILLLNLKSKKNHNVIFFLNPLILYTKLIITEKNDLNKKQLRLVSLTVLEMLNREGIQCFIEAKSQGVSAAEYLFVQIENLRRQRGQGEVFSSSEFRILRQPSYLYLENAFSPDNKTVHIWRHQPLVPNSLSSRCIPLPLYHSISQGNHQHQPAKCLYLKSLPFLKLTFYEALSFLRDLSLVVVVSFTKKNNRCNWSHFAVFKIFFLSAWLERRLEYLVFEYLNYFQLFILILSDEMQVVKNRLYSFLFEFVTSNHCFYSYTTTVLQMAHREAGYYIGKQEFIHWVPELNLENTFGMSFHTFSLKSHPNLWLHIFLSFPPSFTFWKVNSFLNPKCYKSLGEIFPQNLVKKVPHSHLLQVIISCNSFNAMEKLQLLTSQENFSRKIPATFPLSSLSSTIIKTWARSPLTSHSGKAMCCHKKTTSFSVRPEFEFQLNHVGFMVGALSVSISTLVNWGNDTYFKGFLGGLNEVYKFLASGLGLSKYSRNVQFSSSMFLFYSSNGIIETMGQNIFLYSKDCMTEFALEKKNCIKSLIQLYINYITLIQYMVVNSETLPVCLLLSIELVFSFSWLSSCLLILSHMLPSLLVPSSLLYFTRFGTCSPLDFFFNILAFPRCNIFTSLLVKLDISHDLEREEIWNDLISFNYLMLMNACIIVNKGELKILISTFCPQISVSISTRQESAGCMMPFEAASHQTEILITVHEVKQTEFNGNTFCIGPVLKGGKYKFSNKKSLLLLGAVAHTCEYQQFEKLRQVDHLRPGVRDQPGQHSETPSLQKYKKISWAWWCTPIVPATQEAEAGESLEPGKQSLQ

SEQ ID NO: 814971 - protein, 463 aa, Homo sapiens [sequence omitted]

SEQ ID NO: 814972 - protein, 1247 aa, Homo sapiens
MLFRTTFWSLADFPLTPENNSSLKNGNLNVCGNGLVDFFENKLEKVTYNHPFRICKATGKPLINDNQQSSVLICILNAELLGLYKQHEWFLETFKIVSKLVPKWHIIIIHFLFARKSAHRVHSQILNELTLNSFFMLKNNRTNNNTIFGQNPPYLMRTIACAQYLEMHTLHISPHFQLGLPFFARRSYPSLFRLIFYPFLKYKVLRVSEIQDILAQLTQVLYSSLHRPLAAEILFLSSGFTGFSSWVPPKLGETKAFSENLKARLTSDSDSSILHLMYFNSWVLWSVQRPWVRYIHLQYLIGITFLSSLEYSSSHSPNLTTFRFSLPGLPGEVDNLLVVEAPMNVSRDILRGKFLLIDNQDNQVVTQSSLSREHLSFSPLLQLLISGPWNKTIVPKIEHPKSSCLVETADFFDSLAAKPEIDHYGDRMFASIPTKQVKTEVKIILLLNLKSKKNHNVIFFLNPLILYTKLIITEKNDLNKKQLRLVSLTVLEMLNREGIQCFIEAKSQGVSAAEYLFVQIENLRRQRGQGEVFSSSEFRILRQPSYLYLENAFSPDNKTVHIWRHQPLVPNSLSSRCIPLPLYHSISQGNHQHQPAKCLYLKSLPFLKLTFYEALSFLRDLSLVVVVSFTIICLAGKETRVSSFYVFKLLLIIYIDDSLINAGIKNRLYSFLFEFVTSNHCFYSYTTTVLQMAHREAGYYIGKQEFIHWVPELNLENTFGMSFHTFSLKSHPNLWLHIFLSFPPSFTFWKVNSFLNPKCYKSLGEIFPQNLVKKVPHSHLLQVIISCNSFNAMEKLQLLTSQENFSRKIPATFPLSSLSSTIIKTWARSPLTSHSGKAMCCHKKTTSFGVRPEFEFQLNHVGFMVGALSVSISTLVNWGNDTYFYRVFRGIEMKYTVLSLRPRIEVSTQEMCNFLVPCFFSNLQNGIIETMGQNIFLYSKDCMTEFALEKKNCIKSLIQLYINYITLIQYMVVNSETLPVCLLLSIELVFSFSWLSSCLLILSHMLPSLLVPSSLLYFTRFGTCSPLDFFFNILAFPRCNIFTSLLVKLDISHDLEREEIWNDLISFNYAMLMNACIIVNKGELKILISTFCPQISVSISTRQESAGCMMPFEAASHQTEILITVHEVKQTEFNGNTFCIGPVLKGGKYKFSNKKSLLLLGAVAHTCEYQQFEKLRQVDHLRPGVRDQPGQHSETPSLLKIQKNYWAWWCTPIVPATQEAEAGESLEPGKQSLQLSQDRGIALQPGR

SEQ ID NO: 814973 - protein, 824 aa, Homo sapiens
MFASIPTKQVKTEVKIILLLNLKSKKNHNVIFFLNPLILYTKLIITEKNDLNKKQLRLVSLTVLEMLNREGIQCFIEAKSQGVSAAEYLFVQIENLRRQRGQGEVFSSSEFRILRQPSYLYLENAFSPDNKTVHIWRHQPLVPNSLSSRCIPLPLYHSISQGNHQHQPAKCLYLKSLPFLKLTFYEALSFLRDLSLVVVVSFTKKNNRCNWSHFAVFKIFFLSAWLERRLEYLVFEYLNYFQLFILILSDEMQVVKNRLYSFLFEFVTSNHCFYSYTTTVLQMAHREAGYYIGKQEFIHWVPELNLENTFGMSFHTFSLKSHPNLWLHIFLSFPPSFTFWKVNSFLNPKCYKSLGEIFPQNLVKKVPHSHLLQVIISCNSFNAMEKLQLLTSQENFSRKIPATFPLSSLSSTIIKTWARSPLTSHSGKAMCCHKKTTSFGVRPEFEFQLNHVGFMVGALSVSISTLVNWGNDTYFKGFLGGLNEVYKFLASGLGLSKYSRNVQFSSSMFLFYSSNGIIETMGQNIFLYSKDCMTELLKKKKIVIKSLIQLYINYITLIQYMVCEFRDITSLPPSLNRTCIFIFWLSSCLLILSHMLPSLLVPSSLLYFTRFGTCSPLDFFFNILAFPRCNIFTSLLVKLDISHDLEREEIWNDLISFNYLMLMNACIIVNKGELKILISTFCPQISVSISTRQESAGCMMPFEAASHQTEILITVHEVKQTEFNGNTFCIGPVLKGGKYKFSNKKSLLLLGAVAHTCEYQQFEKLRQVDHLRPGVRDQPGQHSETPSLQKYKKISWAWWCTPIVPATQEAEAGESLEPGKQSLQ

SEQ ID NO: 814974 - protein, 461 aa, Homo sapiens
MSRINKNVVLALLTLTSSAFLLFQLYYYKHYLSTKNGAGLSKSKGSRIGFDSTQWRAVKKFIMLTSNQNVPVFLIDPLILELINKNFEQVKNTSHGSTSQCKFFCVPRDFTAFALQYHLWKNEEGWFRIAENMGFQCLKIESKDPRLDGIDSLSGTEIPLHYICKLATHAIHLVVFHERSGNYLWHGHLRLKEHIDRKFVPFRKLQFGRYPGAFDRPELQQVTVDGLEVLIPKDPMHFVEEVPHSRFIECRYKEARAFFQQYLDDNTVEAVAFRKSAKELLQLAAKTLNKLGVPFWLSSGTCLGWYRQCNIIPYSKDVDLGIFIQDYKSDIILAFQDAGLPLKHKFGKVEDSLELSFQGKDDVKLDVFFFYEETDHMWNGGTQAKTGKKFKYLFPKFTLCWTEFVDMKVHVPCETLEYIEANYGKTWKIPVKTWDWKRSPPNVQPNGIWPISEWDEVIQLY

SEQ ID NO: 814975 - protein, 533 aa, Homo sapiens
MSWAARPPFLPQRHAAGQCGPVGVRKEMHCGVASRWRRRRPWLDPAAAAAAAVAGGEQQTPEPEPGEAGRDGMGDSGRDSRSPDSSSPNPLPQGVPPPSPPGPPLPPSTAPSLGGSGAPPPPPMPPPPLGSPFPVISSSMGSPGLPPPAPPGFSGPVSSPQINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSPNDPVTNICQAADKQLFTLVEWAKRIPHFSSLPLDDQVILLRAGWNELLIASFSHRSIDVRDGILLATGLHVHRNSAHSAGVGAIFDRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 814976 - protein, 533 aa, Homo sapiens; identical to SEQ ID NO: 814975

SEQ ID NO: 814977 - protein, 533 aa, Homo sapiens; identical to SEQ ID NO: 814975

SEQ ID NO: 814978 - protein, 533 aa, Homo sapiens; identical to SEQ ID NO: 814975

SEQ ID NO: 814979 - protein, 533 aa, Homo sapiens; identical to SEQ ID NO: 814975

SEQ ID NO: 814980 - protein, 514 aa, Homo sapiens
FRSVQRWLPHWRCHFGTEQSDGLNSTQSRPESFSQGLPRAQLILRSILGNPWDLFGIPTLSQGSCLGPLARPSSLSGMPQGSVGRWGCEKKCIVGSRPGGGGDGPGWIPQRRRRRRWQAENNKPRSRSQGRLDGTGWATAGGINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSPNDPVTNICQAADKQLFTLVEWAKRIPHFSSLPLDDQVILLRAGWNELLIASFSHRSIDVRDGILLATGLHVHRNSAHSAGVGAIFDRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 814981 - protein, 397 aa, Homo sapiens [sequence omitted]

SEQ ID NO: 814982 - protein, 533 aa, Homo sapiens; identical to SEQ ID NO: 814975

SEQ ID NO: 814983 - protein, 382 aa, Homo sapiens
MSWAARPPFLPQRHAAGQCGPVGVRKEMHCGVASRWRRRRPWLDPAAAAAAAVAGGEQQTPEPEPGEAGRDGMGDSGRDSRSPDSSSPNPLPQGVPPPSPPGPPLPPSTAPSLGGSGAPPPPPMPPPPLGSPFPVISSSMGSPGLPPPAPPGFSGPVSSPQINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSVSVGVNPLSFVMGVGGGSLGLFYIPSPSFPLITFLTLLGTGGAAKQGLSNI

SEQ ID NO: 814984 - protein, 382 aa, Homo sapiens; identical to SEQ ID NO: 814983

SEQ ID NO: 814985 - protein, 246 aa, Homo sapiens [sequence omitted]

SEQ ID NO: 814986 - protein, 508 aa, Homo sapiens
MSWAARPPFLPQRHAAGQCGPVGVRKEMHCGVASRWRRRRPWLDPAAAAAAAVAGGEQQTPEPEPGEAGRDGMGDSGRDSRSPDSSSPNPLPQGVPPPSPPGPPLPPSTAPSLGGSGAPPPPPMPPPPLGSPFPVISSSMGSPGLPPPAPPGFSGPVSSPQINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSPNDPVTNICQAADKQLFTLVEWAKRIPHFSSLPLDDQVILLRAGLHVHRNSAHSAGVGAIFDRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 814987 - protein, 533 aa, Homo sapiens; identical to SEQ ID NO: 814975

SEQ ID NO: 814988 - protein, 185 aa, Homo sapiens
RITFVSQGQGNLGASSSPRLLSYPAIPLSKTLNLEISQLAEEKPTSTDPSHKPSGPCFPCQASGKGQASAAQKGHPVAHICMAILIWFVFISLPPLFPAIPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 814989 - protein, 382 aa, Homo sapiens; identical to SEQ ID NO: 814983

SEQ ID NO: 814990 - protein, 195 aa, Homo sapiens
MSWAARPPFLPQRHAAGQCGPVGVRKEMHCGVASRWRRRRPWLDPAAAAAAAVAGGEQQTPEPEPGEAGRDGMGDSGRDSRSPDSSSPNPLPQGVPPPSPPGPPLPPSTAPSLGGSGAPPPPPMPPPPLGSPFPVISSSMGSPGLPPPAPPGFSGPVSSPQVRGCDQLTAWPLSFSCFPCNPRSLCELPHGPLTF

SEQ ID NO: 814991 - protein, 127 aa, Homo sapiens
NLGASSSPRLLSYPAIPLSKTLNLEISQLAEEKPTSTDPSHKPSGPCFPCQASGKGQASAAQKGHPVAHICMAILIWFVFISLPPLFPAIPDAKGLSNPSEVEVLREKVYASLETYCKQKYPEQQGR

SEQ ID NO: 814992 - protein, 114 aa, Homo sapiens [sequence omitted]

SEQ ID NO: 814993 - protein, 555 aa, Homo sapiens
RAAGLSPVSSSCSLGRAAVTVHRRRRGLHRRVRPPASMATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 814994 - protein, 518 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 814995 - protein, 593 aa, Homo sapiens
RAAGLSPVSSSCSLGRAAVTVHRRRRGLHRRVRPPASMATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 814996 - protein, 532 aa, Homo sapiens
RAAGLSPVSSSCSLGRAAVTVHRRRRGLHRRVRPPASMATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 814997 - protein, 541 aa, Homo sapiens
RAAGLSPVSSSCSLGRAAVTVHRRRRGLHRRVRPPASMATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 814998 - protein, 570 aa, Homo sapiens
RAAGLSPVSSSCSLGRAAVTVHRRRRGLHRRVRPPASMATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLEPQTTVVHNATDGIKGSTESCNTTTEDEDLKALVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 814999 - protein, 579 aa, Homo sapiens
RAAGLSPVSSSCSLGRAAVTVHRRRRGLHRRVRPPASMATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 815000 - protein, 576 aa, Homo sapiens
RAAGLSPVSSSCSLGRAAVTVHRRRRGLHRRVRPPASMATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 815001 - protein, 555 aa, Homo sapiens; identical to SEQ ID NO: 814993

SEQ ID NO: 815002 - protein, 555 aa, Homo sapiens; identical to SEQ ID NO: 814993

SEQ ID NO: 815003 - protein, 556 aa, Homo sapiens
WSSRLPIGWTTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 815004 - protein, 563 aa, Homo sapiens
FREDPPPEPRAAPFTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 815005 - protein, 548 aa, Homo sapiens
MATTATCTRFTDDYQLFEELGKCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 815006 - protein, 618 aa, Homo sapiens
RAAGLSPVSSSCSLGRAAVTVHRRRRGLHRRVRPPASMATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKCIDGQGRPRTSQSEETRVWHRRDGKWLNVHYHCSGAPAAPLQ

SEQ ID NO: 815007 - protein, 533 aa, Homo sapiens
SIGLGLSSTLVVVECLKSGSYLLDTPLQDSQGWVSVSLVSLLFNFSSSSVLPGQRYFSVYVGLKAVTLGVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 815008 - protein, 452 aa, Homo sapiens
MSTSETSKHRHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 815009 - protein, 204 aa, Homo sapiens
MEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 815010 - protein, 222 aa, Homo sapiens
ASAAAWAGQVAKSFLNKNSGVVKKRKSSSSVHLMPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 815011 - protein, 141 aa, Homo sapiens
MDFFSPTVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 815012 - protein, 148 aa, Homo sapiens
MRAGVKCAAFPSLEVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 815013 - protein, 119 aa, Homo sapiens
MQVPRPDVLLPTPPCPAVLSKNSKPIHTTILNPHVHVIGEDAACIAYIRLTQYIDGQGRPRTSQSEETRVWHRRDGKCIDGQGRPRTSQSEETRVWHRRDGKWLNVHYHCSGAPAAPLQ

SEQ ID NO: 815014 - protein, 559 aa, Homo sapiens
RAAGLSPVSSSCSLGRAAVTVHRRRRGLHRRVRPPASMATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKEPQTTVVHNATDGIKGSTESCNTTTEDEDLKVRKQEIIKITEQLIEAINNGDFEAYTKICDPGLTSFEPEALGNLVEGMDFHKFYFENREWVRAADILLPAPLPLCLCLLLTFSSQLPTFPLFDLRAALLLCMLVPLCPDGCRQAPLKALLLSSKCHSFCSCFVAVPVTTIKLTYFLPGAVAYACNPNTLGG

SEQ ID NO: 815015 - protein, 593 aa, Homo sapiens; identical to SEQ ID NO: 814995

SEQ ID NO: 815016 - protein, 373 aa, Homo sapiens
RAAGLSPVSSSCSLGRAAVTVHRRRRGLHRRVRPPASMATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKVSVSSL

SEQ ID NO: 815017 - protein, 454 aa, Homo sapiens
RAAGLSPVSSSCSLGRAAVTVHRRRRGLHRRVRPPASMATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVAKAMNKKSDGGSSHRATQNSSKPAKKPAWEGRGHNPWVTNANGSGPRKAAQEEAQGPAGKAGGKAGKTLGEQLFARKEIKTGQGGKEAPTLGEKYTTRGRR

SEQ ID NO: 815018 - protein, 289 aa, Homo sapiens
RSSQRELSTRQRSQAKPPASMASEFKKKLFWRAVVAEFLATTLFVFISIGSALGFKYPVGNNQTAVQDNVKVSLAFGLSIATLAQSVGHISGAHLNPAVTLGLLLSCQISIFRALMYIIAQCVGAIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 815019 - protein, 289 aa, Homo sapiens; identical to SEQ ID NO: 815018

SEQ ID NO: 815020 - protein, 98 aa, Homo sapiens
GRLLLLNSRPRRIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 815021 - protein, 120 aa, Homo sapiens
PATPISPGRAEGMTTLSCRTFQSTLKGTHLLVAPQSMMGGVPESPPSPQSCSPTHLRKCLGFYRNCFVPLGTALLLFLTCTLLPMVLGGGRDPRRCSGGGKLCSFSSACSQAPDPLGLTA

SEQ ID NO: 815022 - protein, 207 aa, Homo sapiens
RSSQRELSTRQRSQAKPPASMASEFKKKLFWRAVVAEFLATTLFVFISIGSALGFKYPVGNNQTAVQDNVKVSLAFGLSIATLAQSVGHISGAHLNPAVTLGLLLSCQISIFRALMYIIAQCVGAIVATAILSGITSSLTGNSLGRNDLADGVNSGQGLGIEIIGTLQLVLCVLATTDRRRRDLGGSAPLAIGLSVALGIVPISGPQ

SEQ ID NO: 815023 - protein, 289 aa, Homo sapiens; identical to SEQ ID NO: 815018

SEQ ID NO: 815024 - protein, 289 aa, Homo sapiens; identical to SEQ ID NO: 815018

SEQ ID NO: 815025 - protein, 289 aa, Homo sapiens; identical to SEQ ID NO: 815018

SEQ ID NO: 815026 - protein, 289 aa, Homo sapiens; identical to SEQ ID NO: 815018

SEQ ID NO: 815027 - protein, 224 aa, Homo sapiens
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSSKRSANEKFTSAQEFS

SEQ ID NO: 815028 - protein, 91 aa, Homo sapiens
MAAPKGSLWVRTQLGLPPLLLLTMALAGGSGTASAEAFDSVLGDTASCHRACQLTYPLHTYPKNRRRPHVNRLKIAKIWIGKPYLKADGQT

SEQ ID NO: 815029 - protein, 224 aa, Homo sapiens; identical to SEQ ID NO: 815027

SEQ ID NO: 815030 - protein, 224 aa, Homo sapiens; identical to SEQ ID NO: 815027

SEQ ID NO: 815031 - protein, 224 aa, Homo sapiens; identical to SEQ ID NO: 815027

SEQ ID NO: 815032 - protein, 224 aa, Homo sapiens; identical to SEQ ID NO: 815027

SEQ ID NO: 815033 - protein, 112 aa, Homo sapiens [sequence omitted]

SEQ ID NO: 815034 - protein, 170 aa, Homo sapiens
MAAPKGSLWEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSSKRSANEKFTSAQEFS

SEQ ID NO: 815035 - protein, 178 aa, Homo sapiens
RASGTTPLSVDTTPLHTEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSSKRSANEKFTSAQEFS

SEQ ID NO: 815036 - protein, 224 aa, Homo sapiens; identical to SEQ ID NO: 815027

SEQ ID NO: 815037 - protein, 224 aa, Homo sapiens; identical to SEQ ID NO: 815027

SEQ ID NO: 815038 - protein, 157 aa, Homo sapiens
MAAPKGSLWVRTQLGLPPLLLLTMALAGGSGTASAEAFDSVLGDTASCHRACQLTYPLHTYPKLMSLMPKMHLLFPLTLVRSFWSDMMDSAQSFITSSWTFYLQADDGKIVIFQSKPEIQYAPHLEQEPTNLRESSLSKMSSKRSANEKFTSAQEFS

SEQ ID NO: 815039 - protein, 224 aa, Homo sapiens; identical to SEQ ID NO: 815027

SEQ ID NO: 815040 - protein, 112 aa, Homo sapiens [sequence omitted]

SEQ ID NO: 815041 - protein, 118 aa, Homo sapiens
RASGTTPLSVDTTPLHTEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITS

SEQ ID NO: 815042 - protein, 213 aa, Homo sapiens
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSSVMAF

SEQ ID NO: 815043 - protein, 105 aa, Homo sapiens
MAAPKGSLWVRTQLGLPPLLLLTMALAGGSGTASAEAFDSVLGDTASCHRACQLTYPLHTYPKVGPVRSGLRPFPCSPFLGSPHVMSALATWLLNRPFNRCLPSV

SEQ ID NO: 815044 - protein, 205 aa, Homo sapiens
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYFNLFPVEIARNVDAFTA

SEQ ID NO: 815045 - protein, 145 aa, Homo sapiens
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQPAMILSVTLVNKLNI

SEQ ID NO: 815046 - protein, 105 aa, Homo sapiens; identical to SEQ ID NO: 815043

SEQ ID NO: 815047 - protein, 105 aa, Homo sapiens; identical to SEQ ID NO: 815043

SEQ ID NO: 815048 - protein, 461 aa, Homo sapiens
MDRGSLLPFQLWCPRPFGTYSQNQPRPPSAALKPSACPEPGGGAEPDHGPAHSENTPPALATEVPASQPAPLLSAAAAGDEGRVLLDTWYVIKPGNTKEKVAFFVAHQCGGGSRASSMKVKGHWGSDSSKAKRRRRCLDPTKAPPDPGGREGPPAAEEGPASAGEDVDLLSVAEMVALVEQRAALALQSYPRPTTPAPVVFVSAEQGGPAKGVGSERRSGGGDCSRVAEAVAHFEAQRDSPPTKNVKEETVCLTVSPEEPPPPGQLFFLQNRGPDGPPEPPPADSPATAPGPDDAEGTADTSLCRLYRHVSHDFLEIRFKIQRLLEPRQYMLLLPEHVLVKIFSFLPTRALAALKCTCHHFKGIIEAFGVRATDSRWSRDPLYRDDPCKQCRKRYEKGDVSLCRWHPKPYHHDLPYGRSYWMCCRRADRETPGCRLGLHDNNWVLPCNGPGGGRAGREEGR

SEQ ID NO: 815049 - protein, 603 aa, Homo sapiens
MDRGSLLPFQLWCPRPFGTYSQNQPRPPSAALKPSACPEPGGGAEPDHGPAHSENTPPALATEVPASQPAPLLSAAAAGDEGRVLLDTWYVIKPGNTKEKVAFFVAHQCGGGSRASSMKVKGHWGSDSSKAKRRRRCLDPTKAPPDPGGREGPPAAEEGPASAGEDVDLLSVAEMVALVEQRAALALQSYPRPTTPAPVVFVSAEQGGPAKGVGSERRSGGGDCSRVAEAVAHFEAQRDSPPTKGLRKEERPGPGPGEVRIAFRISNGREPRAPDSGLPSGGGGRPGCAYPGSPGPGARAKDKITCDLYQLISPSRDALPSNVEFLLARADEASEGDSPAPARPEDTPPAPPPPPARDCGASGFHVDVVVTGVVDECIFFGKDGTKNVKEETVCLTVSPEEPPPPGQLFFLQNRGPDGPPEPPPADSPATAPGPDDAEGTADTSLCRLYRHVSHDFLEIRFKIQRLLEPRQYMLLLPEHVLVKIFSFLPTRALAALKCTCHHFKGIIEAFGVRATDSRWSRDPLYRDDPCKQCRKRYEKGDVSLCRWHPKPYHHDLPYGRSYWMCCRRADRETPGCRLGLHDNNWVLPCNGPGGGRAGREEGR

SEQ ID NO: 815050 - protein, 603 aa, Homo sapiens; identical to SEQ ID NO: 815049

SEQ ID NO: 815051 - protein, 603 aa, Homo sapiens; identical to SEQ ID NO: 815049

SEQ ID NO: 815052 - protein, 529 aa, Homo sapiens [sequence omitted]

SEQ ID NO: 815053 - protein, 76 aa, Homo sapiens
ITFSSAVFLSSGSEGTVLFKKFIQKPMHPLDITGNPTWFLLYHCTEMVISLFHPKIWAMTIAIYKIQVKFTFFQRN

SEQ ID NO: 815054 - protein, 673 aa, Homo sapiens
MAKLETLPVRADPGRDPLLAFAPRPSELGPPDPRLAMGSVGSGVAHAQEFAMKSVGTRTGGGGSQGSFPGPRGSGSGASRERPGRYPSEDKGLANSLYLNGELRGSDHTDVCGNVVGSSGGSSSSGGSDKAPPQYREPSHPPKLLATSGKLDQCSEPLVRPSAFKPVVPKNFHSMQNLCPPQTNGTPEGRQGPGGLKGGLDKSRTMTPAGGSGSGLSDSGRNSLTSLPTYSSSYSQHLAPLSASTSHINRIGTASYGSGSGGSSGGGSGYQDLGTSDSGRASSKSGSSSSMGRPGHLGSGEGGGGGLPFAACSPPSPSALIQELEERLWEKEQEVAALRRSLEQSEAAVAQVLEERQKAWERELAELRQGCSGKLQQVARRAQRAQQGLQLQVLRLQQDKKQLQEEAARLMRQREELEDKVAACQKEQADFLPRIEETKWEVCQKAGEISLLKQQLKDSQADVSQKLSEIVGLRSQLREGRASLREKEEQLLSLRDSFSSKQASLELGEGELPAACLKPALTPVDPAEPQDALATCESDEAKMRRQAGVAAAASLVSVDGEAEAGGESGTRALRREVGRLQAELAAERRARERQGASFAEERRVWLEEKEKVIEYQKQLQLSYVEMYQRNQQLERRLRERGAAGGASTPTPQHGEEKKAWTPSRLERIESTEI

SEQ ID NO: 815055 - protein, 673 aa, Homo sapiens; identical to SEQ ID NO: 815054

SEQ ID NO: 815056 - protein, 673 aa, Homo sapiens; identical to SEQ ID NO: 815054

SEQ ID NO: 815057 - protein, 291 aa, Homo sapiens
SGVLRFAPGSADSGPKMATELEYESVLCVKPDVSVYRIPPRASNRGYRASDWKLDQPDWTGRLRITSKGKTAYIKLEDKVSGELFAQAPVEQYPGIAVETVTDSSRYFVIRIQDGTGRSAFIGIGFTDRGDAFDFNVSLQDHFKWVKQESEISKESQEMDARPKLDLGFKEGQTIKLCIGNITNKKGGASKPRTARGGGLSLLPPPPGGKVTIPPPSSSVAISNHVTPPPIPKSNHGGSDADILLDLDSPAPVTTPAPTPVSVSNDLWGDFSTASSSVPNQAPQPSNWVQF

SEQ ID NO: 815058 - protein, 118 aa, Homo sapiens
SGVLRFAPGSADSGPKMATELEYESVLCVKPDVSVYRIPPRASNRGYRASDWKLDQPDWTGRLRITSKGKTAYIKLEDKVSGELFAQAPVEQYPGIAVETVTDSSRYFVIRIQDGTGG

SEQ ID NO: 815059 - protein, 136 aa, Homo sapiens
SGVLRFAPGSADSGPKMATELEYESVLCVKPDVSVYRIPPRASNRGYRASDWKLDQPDWTGRLRITSKGKTAYIKLEDKVSGELFAQAPVEQYPGIAVETVTDSSRYFVIRIQDGTGKRTGILSGTKLGKQVNAQP

SEQ ID NO: 815060 - protein, 291 aa, Homo sapiens; identical to SEQ ID NO: 815057

SEQ ID NO: 815061 - protein, 287 aa, Homo sapiens
SGVLRFAPGSADSGPKMATELEYESVLCVKPDVSVYRIPPRASNRGYRASDWKLDQPDWTGRLRITSKGKTAYIKLEDKVSGELFAQAPVEQYPGIAVETVTDSSRYFVIRIQDGTGRSAFIGIGFTDRGDAFDFNVSLQDHFKWVKQESEISKESQEMDARPKLDLGFKEGQTIKLCIGNITNKKGGASKPRTARGGGLSLLPPPPGGKVTIPPPSSSVAISNHVTPPPIPKSNHGGSDADILLDLDSPAPVTTTTAIQLGPVLNGIGRTLRTDLRNKNDLEGTNL

SEQ ID NO: 815062 - protein, 306 aa, Homo sapiens
THTHTHTHTHTHTFPVPHAHLWVIVLLATLDYLIYFCTVVNFVTNCHHPPFGFSFSSFTSEQRASDWKLDQPDWTGRLRITSKGKTAYIKLEDKVSGELFAQAPVEQYPGIAVETVTDSSRYFVIRIQDGTGRSAFIGIGFTDRGDAFDFNVSLQDHFKWVKQESEISKESQEMDARPKLDLGFKEGQTIKLCIGNITNKKGGASKPRTARGGGLSLLPPPPGGKVTIPPPSSSVAISNHVTPPPIPKSNHGGSDADILLDLDSPAPVTTPAPTPVSVSNDLWGDFSTASSSVPNQAPQPSNWVQF

SEQ ID NO: 815063 - protein, 275 aa, Homo sapiens
SGVLRFAPGSADSGPKMATELEYESVLCVKPDVSVYRIPPRASNRGYRASDWKLDQPDWTGRLRIRELFAQAPVEQYPGIAVETVTDSSRYFVIRIQDGTGRSAFIGIGFTDRGDAFDFNVSLQDHFKWVKQESEISKESQEMDARPKLDLGFKEGQTIKLCIGNITNKKGGASKPRTARGGGLSLLPPPPGGKVTIPPPSSSVAISNHVTPPPIPKSNHGGSDADILLDLDSPAPVTTPAPTPVSVSNDLWGDFSTASSSVPNQAPQPSNWVQF

SEQ ID NO: 815064 - protein, 276 aa, Homo sapiens
SGVLRFAPGSADSGPKMATELEYESVLCVKPDVSVYRIPPRASNRGYRASDWKLDQPDWTGRLRITSKGKTAYIKLEDKVSGELFAQAPVEQYPGIAVETVTDSSRYFVIRIQDGTGRSAFIGIGFTDRGDAFDFNVSLQDHFKWVKQESEISKESQEMDARPKLDLGFKEGQTIKLCIGNITNKKGGASKPRTARGGGLSLLPPPPGGKVTIPPPSSSVAISNHVTPPPIPKSNHGGSDADILLDLDSPAPVTTPAPTPVSVSNDLWGDFSTASR

SEQ ID NO: 815065 - protein, 153 aa, Homo sapiens
SGVLRFAPGSADSGPKMATELEYESVLCVKPDVSVYRIPPRASNRGYRASDWKLDQPDWTGRLRITSKGKTAYIKLEDKVSGELFAQAPVEQYPGIAVETVTDSSRYFVIRIQDGTGRSAFIGIGFTDRGDAFDFNVSLQDHFNSLQVSEACP

SEQ ID NO: 815066 - protein, 91 aa, Homo sapiens
HRGSLPKWLFPNADSKALDLLDKMLTFNPHKRIEVEQALAHPYLEQYYDPSDEPIAEAPFKFDMELDDLPKEKLKELIFEETARFQPGYRS

SEQ ID NO: 815067 - protein, 360 aa, Homo sapiens [sequence omitted]

SEQ ID NO: 815068 - protein, 700 aa, Homo sapiens
MVPQMSSRFALHVVTCVRAVSCSSSCMGMSVLLGFSRWFFRPSPVGGGVGGAHAHLLILLNFCNPTAGQTSWATPFFRARSHKDRISWTFGSYQYWALCNDLFTKQRYWKMFWMWCYGKSTGLGPIQLGSELPPAYNCGWLWASHSASLLSSSASDCQLESGSNITCLVYGKDYKNTFQLFSIVLQSKYSVNSKSFYMLLYFTKFCCEVSLKCLQTNVTANLRGNPLTNQRRNPPVRNLQGSELITPKLGVCNGVFEALWEYSTGPSLRDLTVFPVVQILYKAIRIIIFLVQQRSLVPFSPLCDGLLSAVAQQFQMAVVDQHLRLASSLCLLRTNTFRAGLDHLRGTGNTPRLWKQVQTPTPGPEAKGAGFGSGQREAVQGWVFLGTGLAFLTLEEGAVRRRNSGGDGGIGPHGAEMDTGLVLLSLVPRTAEDDIIFRWRGESGGRSCPVMCLLQVKVGDKVSADDEAEATVKVVIGGLPAAGRACSDAEDTLCLHVTLAGLGEVEDQGEEVQWGDQVGCNHRTSGGAVARGRRLSGWACVVAEHVVWAVVLDPAMSGQGYRASQHRQSRLSMESRKLSGAAWGTVRPAISPSLMVTLRWWQEQGEREEGPRPALVTKYPMEDASANPVGFLGTSHWLSYLLQIHSVVTEFLPNTLERQKPGAGSAAGQSPFSGNAWSCWSLRERKTSFSRTQAKKANVQ

SEQ ID NO: 815069 - protein, 755 aa, Homo sapiens
MGMSVLLGFSRWFFRPSPVGGGVGGAHAHLLILLNFCNPTAGQTSWATPFFRARSHKDRISWTFGSYQYWALCNDLFTKQRYWKMFWMWCYGKSTGLGPIQLGSELPPAYNCGWLWASHSASLLSSSASDCQLESGSNITCLVYGKDYKNTFQLFSIVLQSKYSVNSKSFYMLLYFTKFCCEVSLKCLQTNVTANLRGNPLTNQRRNPPVRNLQGSELITPKLGVCNGVFEALWEYSTGPSLRDLTVFPVVQILYKAIRIIIFLVQQRSLVPFSPLCDGLLSAVAQQFQMAVWTSIWLASSLCLLRTNTFRAGLDHLRGTGNTPRLWKQVQTPTPGPEAKGAGFGSGQREAVQGWVFLGTGLAFLTLEEGAVRRRNSGGDGGIGPHGAEMDTGLVLLSLVPRTAEDDIIFRWRGESGGRSCPVMCLLQVKVGDKVSADDEAEATVKVVIGGLPAAGRACSDAEDTLCLHVTLAGLGEVEDQGEEVQWGDQVGCNHRTSGGAVARGRRLSGWACVVAEHVVWAVVLDPAMSGQWYRASQHRQSRLSMESRKLSGAAWGTVRPAISPSLMVTLRWWQEQGEREEGPRPALVTKYPMEDASANPVGFLGTSHWLSYLLQIHSVVTEFLPNTLERQKPGAGSAAGQSPFSGNAWSCWSLRERKTSFSRTQAKKANVQSFVIFFIFFYLFIFEIESCSVAQAGVQWRDLHSLQLPPPGVKQFCLSLPSSWDYRHTPPHPANFCVFSRDGFTMSARLVSNS

SEQ ID NO: 815070 - protein, 360 aa, Homo sapiens [sequence omitted]

SEQ ID NO: 815071 - protein, 360 aa, Homo sapiens [sequence omitted]

SEQ ID NO: 815072 - protein, 360 aa, Homo sapiens [sequence omitted]

SEQ ID NO: 815073 - protein, 740 aa, Homo sapiens
MSSSFVIFFIFFYLFIFEIESCSVAQAGVQWRDLHSLQLPPPGVKQFCLSLPSSWDYRHTPPHPANFCVFSRDGFTMSARLVIKLLTSDDSASQSAGITGVSHCTQPVMFLWGSTNVCVLKADDYSKNVNSSSFPFEGKFCLYLGIRRTLWAIVASCTQSHPSTTGTHRKQQPAYFQRKGIFNHQCLEKLFCFPLPSVLFPNFLPKFRVCVFRIIMSHIHTSGLQMLSLESTGNMTPVPCSGTVTCDVLGCVPSTGIPAVSARCRTTMLQTQAWERHVKIKILGKKAPDWVEVGEESWNFVARRSHCPFCLVRLDSNRSQLSAMKVVGEAGEAPLWWDPGQGKPECVKKGCGGVRCPRTLGQRFQTWNKALEEDLLPVSSAGPRVSSPCAEGPVLRPVWRVRQGPIGHVIIPSACLLFNPRECSFFILPLKSKLFPFHGELARLYRLGNVGFLRWNHLHKEEEGTKTTDETHDRAEHLEANPGCFSRIALWLGAVVHTCELQHFGRLRQVDCLNPGVRDQPGQHMGHPTAPGSAKKLKISQAWCHEPVVSTTQEAEAGGSLEPGRSRLQCTIIVPLHCSLGDNLFSKLLLKVYCITYSKKQWFSNTFITDILLLNEISRTFSALNKQGWEPVYLPQKHNVPAIEEPKNGDGKLRGEQMSQKTEQLRKQNKTTDDCERLHSGPRKDRELAAWASLSGRQQEGLARELSTVIYTSLKVQEEMIKAIGEVIQIGEGQAMADKT

SEQ ID NO: 815074 - protein, 360 aa, Homo sapiens [sequence omitted]

SEQ ID NO: 815075 - protein, 233 aa, Homo sapiens
MAAAAAAGAGPEMVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILADFGILDPIQETLMI

SEQ ID NO: 815076 - protein, 785 aa, Homo sapiens
MAAFPAALNRPTGARARRRRISAHSAASAAAAVVVAGTARGMVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLPSPGPHNFPLGLHCQVRGPGGGQRSGLSVPAAPGLEHQDRVLLGSKDIGSKNEGSPMPGLQPSVMEDDILMDLI

SEQ ID NO: 815077 - protein, 636 aa, Homo sapiens
NKSWYWAAPRRLRPLRGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPAAKRKREGEGRVFREKWERAYFFVEVKSMPMCLICKQIVSVLKEYNLKRHYESKHSKSYDQYTEQTRDAILNELKKGLKCQ

SEQ ID NO: 815078 - protein, 837 aa, Homo sapiens
MAAFPAALNRPTGARARRRRISAHSAASAAAAVVVAGTARGMVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPAAKRKREGEGRVFREKWERAYFFVEVKSMPMCLICKQIVSVLKEYNLKRHYESKHSKSYDQYTEQTRDAILNELKKGLKCQ

SEQ ID NO: 815079 - protein, 666 aa, Homo sapiens
MREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPAAKRKREGEGRVFREKWERAYFFVEVKSMPMCLICKQIVSVLKEYNLKRHYESKHSKSYDQYTEQTRDAILNELKKGLKCQ

SEQ ID NO: 815080 - protein, 844 aa, Homo sapiens
MAAFPAALNRPTGARARRRRISAHSAASAAAAVVVAGTARGMVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKGAFPHLGFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPAAKRKREGEGRVFREKWERAYFFVEVKSMPMCLICKQIVSVLKEYNLKRHYESKHSKSYDQYTEQTRDAILNELKKGLKCQ

SEQ ID NO: 815081 - protein, 763 aa, Homo sapiens
YYCQVLYPSNGISSTTASLLETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPAAKRKREGEGRVFREKWERAYFFVEVKSMPMCLICKQIVSVLKEYNLKRHYESKHSKSYDQYTEQTRDAILNELKKGLKCQ

SEQ ID NO: 815082 - protein, 636 aa, Homo sapiens; identical to SEQ ID NO: 815077

SEQ ID NO: 815083 - protein, 459 aa, Homo sapiens
RGGRHLQSQLLGRLRQENGVNPGGGVCSEPRWHHCTPARANGAKTLSQKKNKDPKQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPAAKRKREGEGRVFREKWERAYFFVEVKSMPMCLICKQIVSVLKEYNLKRHYESKHSKSYDQYTEQTRDAILNELKKGLKCQ

SEQ ID NO: 815084 - protein, 636 aa, Homo sapiens; identical to SEQ ID NO: 815077

SEQ ID NO: 815085 - protein, 101 aa, Homo sapiens
VLWEHSEESEIFLVPMSLSQAAKRKREGEGRVFREKWERAYFFVEVKSMPMCLICKQIVSVLKEYNLKRHYESKHSKSYDQYTEQTRDAILNELKKGLKCQ

SEQ ID NO: 815086 - protein, 636 aa, Homo sapiens; identical to SEQ ID NO: 815077

SEQ ID NO: 815087 - protein, 636 aa, Homo sapiens; identical to SEQ ID NO: 815077

SEQ ID NO: 815088 - protein, 788 aa, Homo sapiens
MAAFPAALNRPTGARARRRRISAHSAASAAAAVVVAGTARGMVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPGQMLLSGGPRGPVPQPGLQPSVMEDDILMDLI

SEQ ID NO: 815089 - protein, 786 aa, Homo sapiens
MAAFPAALNRPTGARARRRRISAHSAASAAAAVVVAGTARGMVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPGKGTRGRAEVWTECPSSSWARAPRPSAPGK

SEQ ID NO: 815090 - protein, 303 aa, Homo sapiens
MAAFPAALNRPTGARARRRRISAHSAASAAAAVVVAGTARGMVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAART

SEQ ID NO: 815091 - protein, 143 aa, Homo sapiens
MAAFPAALNRPTGARARRRRISAHSAASAAAAVVVAGTARGMVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIK

SEQ ID NO: 815092 - protein, 30 aa, Homo sapiens
MLGWGSESSRSWPWWFWSCCLGGGRLTVVS

SEQ ID NO: 815093 - protein, 36 aa, Homo sapiens
MGSVSPSTLSQEAAGVSLGDAWPVPGLSIPIRKQCQ

SEQ ID NO: 815094 - protein, 184 aa, Homo sapiens
MLGWPGPPAGGWGPGAASHDGPSRESLAVPTFPALGESPGRFRTHPQRNPAHARRLLRPLRSLPSHVTWPSLGNRTPPSPASPPGTMAEECPRACAEPVAPKATAPPERTSDYYRVSADLPGRFNNPGWFRGYRTQKAVSVYRTSNQAYGSRAPTVHEMPCSGWNVPEQYSQCLPGEKHRDWPR

SEQ ID NO: 815095 - protein, 116 aa, Homo sapiens
EVGIRAVGGRAVGGESPVVVSAPLICVGTQKAVSVYRTSNQAYGSRAPTVHEMPKVFYPNSNKFSQQLAAGGMFRNNTLNVYLEKSIVTGPDNCITSCDRLNFHPSYNINRPSICD

SEQ ID NO: 815096 - protein, 136 aa, Homo sapiens
MAEECPRACAEPVAPKATAPPERTSDYYRVSADLPGRFNNPGWFRGYRTQKAVSVYRTSNQAYGSRAPTVHEMPKVFYPNSNKFSQQLAAGGMFRNNTLNVYLEKSIVTGPDNCITSCDRLNFHPSYNINRPSICD

SEQ ID NO: 815097 - protein, 107 aa, Homo sapiens
GLEAKPPLLQARLPRNCSMCRGPARAGDQHLLAACSLGLWPALEEQGQWQAEGAGEAGPFRTVISQVLPEAAFEATSPARAYCSFHGGISRGVPSTKYKAVACAELE

SEQ ID NO: 815098 - protein, 154 aa, Homo sapiens
GEPGAQQPQERPGSTGTFSGNRGLEPGSDPDLAPGHVTWPSLGNRTPPSPASPPGTMAEECPRACAEPVAPKATAPPERTSDYYRVSADLPGRFNNPGWFRGYRTQKAVSVYRTSNQAYGSRAPTVHEMPCSGWNVPEQYSQCLPGEKHRDWPR

SEQ ID NO: 815099 - protein, 163 aa, Homo sapiens
MAEECPRACAEPVAPKATAPPERTSDYYRVSADLPGRFNNPGWFRGYRTQKAVSVYRTSNQAYGSRAPTVHEMPKVFYPNSNKFSQQLAAGGMFRNNTLNVYLEKSIVTGPDNCITSWKIIIPHHPQSPDCDGTDCAAFPENIIRLRSRKICKRGREVLPFHI

SEQ ID NO: 815100 - protein, 100 aa, Homo sapiens
MAEECPRACAEPVAPKATAPPERTSDYYRVSADLPGRFNNPGWFRGYRTQKAVSVYRTSNQAYGSRAPTVHEMPTQKAVSVYRTSNQAYGSRAPTVHEMP

SEQ ID NO: 815101 - protein, 200 aa, Homo sapiens [sequence omitted]

SEQ ID NO: 815102 - protein, 176 aa, Homo sapiens
MKVLLCDLLLLSLFSSVFSSCQRDCLTCQEKLHPALDSFDLEVCILECEEKVFPSPLWTPCTKVMARSSWQLSPAAPEHVAAALYQPRASEMQHLRRMPRVRSLFQEQEEPEPGMEEAGEMEQKQLQKRFGGFTGARKSARKLANQKRFSEFMRQYLVLSMQSSQRRRTLHQNGNV

SEQ ID NO: 815103 - protein, 112 aa, Homo sapiens
MARSSWQLSPAAPEHVAAALYQPRASEMQHLRRMPRVRSLFQEQEEPEPGMEEAGEMEQKQLQKRFGGFTGARKSARKLANQKRFSEFMRQYLVLSMQSSQRRRTLHQNGNV

SEQ ID NO: 815104 - protein, 112 aa, Homo sapiens; identical to SEQ ID NO: 815103

SEQ ID NO: 815105 - protein, 112 aa, Homo sapiens; identical to SEQ ID NO: 815103

SEQ ID NO: 815106 - protein, 112 aa, Homo sapiens; identical to SEQ ID NO: 815103

SEQ ID NO: 815107 - protein, 584 aa, Homo sapiens
LVPAREHIRGLEASGKGLRQCRTRNARGTKAPQSVAPASSSRKSVSRHWHPGTSGAAELGGRSSCEDPGCPRDEERAPRMGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 815108 - protein, 561 aa, Homo sapiens
GGTEDEEDDQEDDEGEEGDEDDDDDGSEGTSGAAELGGRSSCEDPGCPRDEERAPRMGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 815109 - protein, 530 aa, Homo sapiens
EFLSKIQPFQEIEISTWGLPENVRLMGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 815110 - protein, 92 aa, Homo sapiens
AAAYYYYCSEFKLLTMYGAMIGRTRAGPGGAQVVAARWLQHHPPGPTPPSYSQTPTLASATVSSSVQWVGWTGKSLFDSCNPQSDILRKPPS

SEQ ID NO: 815111 - protein, 382 aa, Homo sapiens
ALLPRSQWVRVGLEAIAAGPYSSPPTQTMESALAVPRLPPHDPGTPVLSVVDMHTGGEPLRIVLAGCPEVSGPTLLAKRRYMRQHLDHVRRRLMFEPRGHRDMYGAVLVPSELPDAHLGVLFLHNEGYSSMCGHAVLALGRFALDFGLVPAPPAGTREARVNIHCPCGLVTAFVACEDGRSHGPVRFHSVPAFVLATDLMVDVPGHGKVMVDIAYGGAFYAFVTAEKLGLDICSAKTRDLVDAASAVTEAVKAQFKINHPDSEDLAFLYGTILTDGKDAYTKEPTTNICVFADEQVDRSPTGSGVTARIALQYHKGLLELNQMRAFKSSATGSVFTGKAVREAKCGDFKAVIVEVSGQAHYTGTASFIIEDDDPLRDGFLLK

SEQ ID NO: 815112 - protein, 382 aa, Homo sapiens; identical to SEQ ID NO: 815111

SEQ ID NO: 815113 - protein, 237 aa, Homo sapiens
ALLPRSQWVRVGLEAIAAGPYSSPPTQTMESALAVPRLPPHDPGTPVLSVVDMHTGGEPLRIVLAGCPEVSGPTLLAKRRYMRQHLDHVRRRLMFEPRGHRDMYGAVLVPSELPDAHLGVLFLHNEGYSSMCGHAVLALGRFALDFGLVPAPPAGTREARVNIHCPCGLVTAFVACEDGRSHGPVRFHSVPAFVLATGNGRDLSSPGQSCNRDATNYINGFSGLELWQLTYSAKPCN

SEQ ID NO: 815114 - protein, 237 aa, Homo sapiens; identical to SEQ ID NO: 815113

SEQ ID NO: 815115 - protein, 220 aa, Homo sapiens
ALLPRSQWVRVGLEAIAAGPYSSPPTQTMESALAVPRLPPHDPGTPVLSVVDMHTGGEPLRIVLAGCPEVSGPTLLAKRRYMRQHLDHVRRRLMFEPRGHRDMYGAVLVPSELPDAHLGVLFLHNEGYSSMCGHAVLALGRFALDFGLVPAPPAGTREARVNIHCPCGLVTAFVACEDGRSHGPVRFHSVMGGTFPAQGRAATGTRLTTLTVFLGWNSGN

SEQ ID NO: 815116 - protein, 344 aa, Homo sapiens
ALLPRSQWVRVGLEAIAAGPYSSPPTQTMESALAVPRLPPHDPGTPVLSVVDMHTGGEPLRIVLAGCPEVSGPTLLAKRRYMRQHLDHVRRRLMFEPRGHRDMYGAVLVPSELPDAHLGVLFLHNEGYSSMCGHAVLALGRFALDFGLVPAPPAGTREARVNIHCPCGLVTAFVACEDGRSHGPVRFHSVPAFVLATDLMVDVPGHGKVMVDIAYGGAFYAFVTAEKLGLDICSAKTRDLVDAASAVTEAVKAQFKINHPDSEDLAFLYGTILTDGKDAYTKEPTTNICVFADEQVDRSPTGSGVTARIALQYHKGLLELNQMRAFKSSATGSVFTGKAVRELL

SEQ ID NO: 815117 - protein, 344 aa, Homo sapiens; identical to SEQ ID NO: 815116

SEQ ID NO: 815118 - protein, 237 aa, Homo sapiens; identical to SEQ ID NO: 815113

SEQ ID NO: 815119 - protein, 237 aa, Homo sapiens; identical to SEQ ID NO: 815113

SEQ ID NO: 815120 - protein, 2230 aa, Homo sapiens
MFKKLKQKISEEQQQLQQALAPAQASSNSSTPTRMRSRTSSFTEQLDEGTPNRESGDTQSFAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMFTSPRSGIF

SEQ ID NO: 815121 - protein, 248 aa, Homo sapiens
MFKKLKQKISEEQQQLQQALAPAQASSNSSTPTRMRSRTSSFTEQLDEGTPNRENASTHASKSPDSVNGSEPSIPQSGDTQSLAQKLQLRVPSVESLFRSPIKESLFRSSSKESLVRTSSRESLNRLDLDSSTASFDPPSDMDSEAEDLVGNSDSLNKEQLIQLVRRMERSLSSYRGKYTGGDIRSSQGESLAGIAAHRGSPQGPLRPRQLLSQRTMEAPFSGHTSIRGVRTSVFTTTPYEGAEQLVT

SEQ ID NO: 815122 - protein, 97 aa, Homo sapiens
DPSEQLGRKIKQEQEDLELKHNSTLKQLMREFNTQLAQKEQELEMTIKETINKAQEVEADHVLGEQEVSYYGQDLDLGPGLGLDLGPGLGLDLALEA

SEQ ID NO: 815123 - protein, 2250 aa, Homo sapiens
MFKKLKQKISEEQQQLQQALAPAQASSNSSTPTRMRSRTSSFTEQLDEGTPNRENASTHASKSPDSVNGSEPSIPQSGDTQSFAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMSWLRSSS

SEQ ID NO: 815124 - protein, 2250 aa, Homo sapiens
MFKKLKQKISEEQQQLQQALAPAQASSNSSTPTRMRSRTSSFTEQLDEGTPNRENASTHASKSPDSVNGSEPSIPQSGDTQSLAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMSWLRSSS

SEQ ID NO: 815125 - protein, 2250 aa, Homo sapiens; identical to SEQ ID NO: 815123

SEQ ID NO: 815126 - protein, 2109 aa, Homo sapiens
MDSEAEDLVGNSDSLNKEQLIQRLRRMERSLSSYRGKYSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMSWLRSSS

SEQ ID NO: 815127 - protein, 1238 aa, Homo sapiens
MLRPTLRIPCSSSCAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMFTSPRSGIF

SEQ ID NO: 815128 - protein, 1219 aa, Homo sapiens
PALAYQDTESKTPYVKKIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMFTSPRSGIF

SEQ ID NO: 815129 - protein, 1112 aa, Homo sapiens
SVVAAEVRGDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMFTSPRSGIF

SEQ ID NO: 815130 - protein, 2252 aa, Homo sapiens
MFKKLKQKISEEQQQLQQALAPAQASSNSSTPTRMRSRTSSFTEQLDEGTPNRENASTHASKSPDSVNGSEPSIPQSGDTQSFAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMFTSPRSGIF

SEQ ID NO: 815131 - protein, 2252 aa, Homo sapiens; identical to SEQ ID NO: 815130

SEQ ID NO: 815132 - protein, 2252 aa, Homo sapiens; identical to SEQ ID NO: 815130

SEQ ID NO: 815133 - protein, 2252 aa, Homo sapiens; identical to SEQ ID NO: 815130

SEQ ID NO: 815134 - protein, 2252 aa, Homo sapiens; identical to SEQ ID NO: 815130

SEQ ID NO: 815135 - protein, 521 aa, Homo sapiens
EEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMSWLRSSSSRRVTLGDCCLENCPHLLLFENEVVIQGPSSSQKTKKNLAHRKLQTAFNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMFTSPRSGIF

SEQ ID NO: 815136 - protein, 2215 aa, Homo sapiens
MFKKLKQKISEEQQQLQQALAPAQASSNSSTPTRMRSRTSSFTEQLDEGTPNRENASTHASKSPDSVNGSEPSIPQSGDTQSFAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKV

SEQ ID NO: 815137 - protein, 235 aa, Homo sapiens
IRGWESLAKLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMFTSPRSGIF

SEQ ID NO: 815138 - protein, 2154 aa, Homo sapiens
MFKKLKQKISEEQQQLQQALAPAQASSNSSTPTRMRSRTSSFTEQLDEGTPNRENASTHASKSPDSVNGSEPSIPQSGDTQSFAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTNYGAYRHSTHRQSDYHLCFVYCKTPRVP

SEQ ID NO: 815139 - protein, 2057 aa, Homo sapiens
MFKKLKQKISEEQQQLQQALAPAQASSNSSTPTRMRSRTSSFTEQLDEGTPNRENASTHASKSPDSVNGSEPSIPQSGDTQSFAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEGGSKCNHDCI

SEQ ID NO: 815140 - protein, 164 aa, Homo sapiens
EEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMFTSPRSGIF

SEQ ID NO: 815141 - protein, 114 aa, Homo sapiens
MQHYNPNDNTNRQHQQSIYTKNRGRRRTDLKHETNKLNELNRRGAERQDNNKEEHQTPKSRERHETDKGEEKEDTREDSSSELDEEERDKPRDTREYEQAGRNSRAQKDSNNRE

SEQ ID NO: 815142 - protein, 183 aa, Homo sapiens
MSSPSPGKRRMDTDVVKLIESKHEVTILGGLNEFVVKFYGPQGTPYEGGVWKVRVDLPDKYPFKSPSIGFMNKIFHPNIDEASGTVCLDVINQTWTALYDLTNIFESFLPQLLAYPNPIDPLNGDAAAMYLHRPEEYKQKIKEYIQKYATEEALKEQEEGTGDSSSESSMSDFSEDEAQDMEL

SEQ ID NO: 815143 - protein, 183 aa, Homo sapiens; identical to SEQ ID NO: 815142

SEQ ID NO: 815144 - protein, 183 aa, Homo sapiens; identical to SEQ ID NO: 815142

SEQ ID NO: 815145 - protein, 113 aa, Homo sapiens
MNKIFHPNIDEASGTVCLDVINQTWTALYDLTNIFESFLPQLLAYPNPIDPLNGDAAAMYLHRPEEYKQKIKEYIQKYATEEALKEQEEGTGDSSSESSMSDFSEDEAQDMEL

SEQ ID NO: 815146 - protein, 152 aa, Homo sapiens
MSSPSPGKRRMDTDVVKLIESKHEVTILGGLNEFVVKFYGPQGTPYEGGVWKVRVDLPDKYPFKSPSIDLTNIFESFLPQLLAYPNPIDPLNGDAAAMYLHRPEEYKQKIKEYIQKYATEEALKEQEEGTGDSSSESSMSDFSEDEAQDMEL

SEQ ID NO: 815147 - protein, 113 aa, Homo sapiens; identical to SEQ ID NO: 815145

SEQ ID NO: 815148 - protein, 103 aa, Homo sapiens
VNFEVNLHFPCVTCLFGFSDLTNIFESFLPQLLAYPNPIDPLNGDAAAMYLHRPEEYKQKIKEYIQKYATEEALKEQEEGTGDSSSESSMSDFSEDEAQDMEL

SEQ ID NO: 815149 - protein, 183 aa, Homo sapiens; identical to SEQ ID NO: 815142

SEQ ID NO: 815150 - protein, 101 aa, Homo sapiens
SWGAAAHTFPCKLSLLCCSSQYPFPQGAKCRNPVPKKSPMGFSLAVVIMITVIFVPPGVQEYIQKYATEEALKEQEEGTGDSSSESSMSDFSEDEAQDMEL

SEQ ID NO: 815151 - protein, 183 aa, Homo sapiens; identical to SEQ ID NO: 815142

SEQ ID NO: 815152 - protein, 183 aa, Homo sapiens; identical to SEQ ID NO: 815142

SEQ ID NO: 815153 - protein, 183 aa, Homo sapiens; identical to SEQ ID NO: 815142

SEQ ID NO: 815154 - protein, 183 aa, Homo sapiens; identical to SEQ ID NO: 815142

SEQ ID NO: 815155 - protein, 183 aa, Homo sapiens; identical to SEQ ID NO: 815142

SEQ ID NO: 815156 - protein, 183 aa, Homo sapiens; identical to SEQ ID NO: 815142

SEQ ID NO: 815157 - protein, 130 aa, Homo sapiens
MSSPSPGKRRMDTDVVKLGPCWRLELLVLEKRMQAKGRRHRSSALIGRPVTTRKRRRGGATKQLMDIESKHEVTILGGLNEFVVKFYGPQGTPYEGGVWKVRVDLPDKYPFKSPSIGFMNKIFHPNIDEA

SEQ ID NO: 815158 - protein, 190 aa, Homo sapiens
RPRAPQSRGPGPVTDGPRKGERRRRHHVISQSGQEADGHGRGQAVSFVEGNSGCVWGAVWGCPGHPRNHCKGPGALQATVRDSPPPPVPTAAPWHLPGAESLFSSPFLRSTPKYALLLALPVSPEPVTFLRDVWTPETAFFLFARPVASLSTTEPIFRVSLSCLLALDLGNQGRNSREGSLSPFLEMPPF

SEQ ID NO: 815159 - protein, 277 aa, Homo sapiens
MALVHKLLRGTYFLRKFSKPTSALYPFLGIRFAEYSSSLQKPVASPGKASSQRKTEGDLQGDHQKEVALDITSSEEKPDVSFDKAIRDEAIYHFRLLKDEIVDHWRGPEGHPLHEVLLEQAKVVWQFRGKEDLDKWTVTSDKTIGGRSEVFLKMGKNNQSALLYGTLSSEAPQDGESTRSGYCAMISRIPRGAFERKMSYDWSQFNTLYLRVRGDGRPWMVNIKEDTDFFQRTNQMYSYFMFTRGGPYWQEVKFFPISLNQETGATNRESYCEKGNR

SEQ ID NO: 815160 - protein, 110 aa, Homo sapiens
RPCLKKKNFFFLTGSSLCTCRFRLFSEFSTVGTNSEIPFSKFFFSNRGRIRDVQHELPLDKISSIGFTLADKVDGPFFLEIDFIGVFTDPAHTEEFAYENSPELNPRLFK

SEQ ID NO: 815161 - protein, 327 aa, Homo sapiens
MALVHKLLRGTYFLRKFSKPTSALYPFLGIRFAEYSSSLQKPVASPGKASSQRKTEGDLQGDHQKEVALDITSSEEKPDVSFDKAIRDEAIYHFRLLKDEIVDHWRGPEGHPLHEVLLEQAKVVWQFRGKEDLDKWTVTSDKTIGGRSEVFLKMGKNNQSALLYGTLSSEAPQDGESTRSGYCAMISRIPRGAFERKMSYDWSQFNTLYLRVRGDGRPWMVNIKEDTDFFQRTNQMYSYFMFTRGGPYWQEVKIPFSKFFFSNRGRIRDVQHELPLDKISSIGFTLADKVDGPFFLEIDFIGVFTDPAHTEEFAYENSPELNPRLFK

SEQ ID NO: 815162 - protein, 327 aa, Homo sapiens; identical to SEQ ID NO: 815161

SEQ ID NO: 815163 - protein, 327 aa, Homo sapiens; identical to SEQ ID NO: 815161

SEQ ID NO: 815164 - protein, 327 aa, Homo sapiens; identical to SEQ ID NO: 815161

SEQ ID NO: 815165 - protein, 327 aa, Homo sapiens; identical to SEQ ID NO: 815161

SEQ ID NO: 815166 - protein, 327 aa, Homo sapiens; identical to SEQ ID NO: 815161

SEQ ID NO: 815167 - protein, 674 aa, Homo sapiens
MHHRMNEMNLSPVGMEQLTSSSVSNALPVSGSHLGLAASPTHSAIPAPGLPVAIPNLGPSLSSLPSALSLMLPMGIGDRGVMCGLPERNYTLPPPPYPHLESSYFRTILPGILSYLADRPPPQYIHPNSINVDGNTALSITNNPSALDPYQSNGNVGLEPGIVSIDSRSVNTHGAQSLHPSDGHEVALDTAITMENVSRVTSPISTDGMAEELTMDGVAGEHSQIPNGSRSHEPLSVDSVSNNLAADAVGHGGVIPMHGNGLELPVVMETDHIASRVNGMSDSALSDSIHTVAMSTNSVSVALSTSHNLASLESVSLHEVGLSLEPVAVSSITQEVAMGTGHVDVSSDSLSFVSPSLQMEDSNSNKENMATLFTIWCTLCDRAYPSDCPEHGPVTFVPDTPIESRARLSLPKQLVLRQSIVGAEVGVWTGETIPVRTCFGPLIGQQSHSMEVAEWTDKAVNHIWKIYHNGVLEFCIITTDENECNWMMFVRKARNREEQNLVAYPHDGKIFFCTSQDIPPENELLFYYSRDYAQQIGVPEHPDVHLCNCGKECNSYTEFKAHLTSHIHNHLPTQGHSGSHGPSHSKERKWKCSMCPQAFISPSKLHVHFMGHMGMKPHKCDFCSKAFSDPSNLRTHLKIHTGQKNYRCTLCDKSFTQKAHLGVPHGYPHWGEES

SEQ ID NO: 815168 - protein, 674 aa, Homo sapiens; identical to SEQ ID NO: 815167

SEQ ID NO: 815169 - protein, 674 aa, Homo sapiens; identical to SEQ ID NO: 815167

SEQ ID NO: 815170 - protein, 674 aa, Homo sapiens; identical to SEQ ID NO: 815167

SEQ ID NO: 815171 - protein, 137 aa, Homo sapiens
MVIHTGEKNLKCDYCDKLFMRRQDLKQHVLIHTQERQIKCPKCDKLFLRTNHLKKHLNSHEGKRDYVCEKCTKAYLTKYHLTRHLKTCKGPTSSSSAPEEEEEDDSEEEDLADSVGTEDCRINSAVYSADESLSAHK

SEQ ID NO: 815172 - protein, 137 aa, Homo sapiens; identical to SEQ ID NO: 815171

SEQ ID NO: 815173 - protein, 674 aa, Homo sapiens; identical to SEQ ID NO: 815167

SEQ ID NO: 815174 - protein, 674 aa, Homo sapiens; identical to SEQ ID NO: 815167

SEQ ID NO: 815175 - protein, 126 aa, Homo sapiens
SSFRLPRGVTIRAVASRLQGTTILISLTSVLHDNKEFPNPEMFDPHHFLDEGGNFKKSKYFMPFSAGKRICVGEALAGMELFLFLTSILQNFNLKSLVDPKNLDTTPVVNGFASVPPFYQLCFIPV

SEQ ID NO: 815176 - protein, 490 aa, Homo sapiens [sequence omitted]

SEQ ID NO: 815177 - protein, 490 aa, Homo sapiens [sequence omitted]

SEQ ID NO: 815178 - protein, 472 aa, Homo sapiens
MDSLVVLVLCLSCLLLLSLWRQSSGRGSIKDISKSLTNLSKVYGPVFTLYFGLKPIVVLHGYEAVKEALIDLGEEFSGRGIFPLAERANRGFGIVFSNGKKWKEIRRFSLMTLRNFGMGKRSIEDRVQEEARCLVEELRKTKASPCDPTFILGCAPCNVICSIIFHKRFDYKDQQFLNLMEKLNENIKILSSPWIQICNNFSPIIDYFPGTHNKLLKNVAFMKSYILEKVKEHQESMDMNNPQDFIDCFLMKMEKEKHNQPSEFTIESLENTAVDLFGAGTETTSTTLRYALLLLLKHPEVTAKVQEEIERVIGRNRSPCMQDRSHMPYTDAVVHEVQRYIDLLPTSLPHAVTCDIKFRNYLIPKGTTILISLTSVLHDNKEFPNPEMFDPHHFLDEGGNFKKSKYFMPFSAGKRICVGEALAGMELFLFLTSILQNFNLKSLVDPKNLDTTPVVNGFASVPPFYQLCFIPV

SEQ ID NO: 815179 - protein, 362 aa, Homo sapiens
MTLRNFGMGKRSIEDRVQEEARCLVEELRKTKASPCDPTFILGCAPCNVICSIIFHKRFDYKDQQFLNLMEKLNENIKILSSPWIQICNNFSPIIDYFPGTHNKLLKNVAFMKSYILEKVKEHQESMDMNNPQDFIDCFLMKMEKEKHNQPSEFTIESLENTAVDLFGAGTETTSTTLRYALLLLLKHPEVTAKVQEEIERVIGRNRSPCMQDRSHMPYTDAVVHEVQRYIDLLPTSLPHAVTCDIKFRNYLIPKGTTILISLTSVLHDNKEFPNPEMFDPHHFLDEGGNFKKSKYFMPFSAGKRICVGEALAGMELFLFLTSILQNFNLKSLVDPKNLDTTPVVNGFASVPPFYQLCFIPV

SEQ ID NO: 815180 - protein, 362 aa, Homo sapiens; identical to SEQ ID NO: 815179

SEQ ID NO: 815181 - protein, 293 aa, Homo sapiens
MEKLNENIKILSSPWIQICNNFSPIIDYFPGTHNKLLKNVAFMKSYILEKVKEHQESMDMNNPQDFIDCFLMKMEKEKHNQPSEFTIESLENTAVDLFGAGTETTSTTLRYALLLLLKHPEVTAKVQEEIERVIGRNRSPCMQDRSHMPYTDAVVHEVQRYIDLLPTSLPHAVTCDIKFRNYLIPKGTTILISLTSVLHDNKEFPNPEMFDPHHFLDEGGNFKKSKYFMPFSAGKRICVGEALAGMELFLFLTSILQNFNLKSLVDPKNLDTTPVVNGFASVPPFYQLCFIPV

SEQ ID NO: 815182 - protein, 293 aa, Homo sapiens; identical to SEQ ID NO: 815181

SEQ ID NO: 815183 - protein, 472 aa, Homo sapiens
MDSLVVLVLCLSCLLLLSLWRQSSGRGKLPPGPTPLPVIGNILQIGIKDISKSLTNLSKVYGPVFTLYFGLKPIVVLHGYEAVKEALIDLGEEFSGRGIFPLAERANRGFGIVFSNGKKWKEIRRFSLMTLRNFGMGKRSIEDRVQEEARCLVEELRKTKASPCDPTFILGCAPCNVICSIIFHKRFDYKDQQFLNLMEKLNAIIDYFPGTHNKLLKNVAFMKSYILEKVKEHQESMDMNNPQDFIDCFLMKMEKEKHNQPSEFTIESLENTAVDLFGAGTETTSTTLRYALLLLLKHPEVTAKVQEEIERVIGRNRSPCMQDRSHMPYTDAVVHEVQRYIDLLPTSLPHAVTCDIKFRNYLIPKGTTILISLTSVLHDNKEFPNPEMFDPHHFLDEGGNFKKSKYFMPFSAGKRICVGEALAGMELFLFLTSILQNFNLKSLVDPKNLDTTPVVNGFASVPPFYQLCFIPV

SEQ ID NO: 815184 - protein, 472 aa, Homo sapiens; identical to SEQ ID NO: 815178

SEQ ID NO: 815185 - protein, 472 aa, Homo sapiens; identical to SEQ ID NO: 815178

SEQ ID NO: 815186 - protein, 454 aa, Homo sapiens
MDSLVVLVLCLSCLLLLSLWRQSSGRGSIKDISKSLTNLSKVYGPVFTLYFGLKPIVVLHGYEAVKEALIDLGEEFSGRGIFPLAERANRGFGIVFSNGKKWKEIRRFSLMTLRNFGMGKRSIEDRVQEEARCLVEELRKTKASPCDPTFILGCAPCNVICSIIFHKRFDYKDQQFLNLMEKLNENIKILSSPWIQICNNFSPIIDYFPGTHNKLLKNVAFMKSYILEKVKEHQESMDMNNPQDFIDCFLMKMEKEKHNQPSEFTIESLVRYALLLLLKHPEVTAKVQEEIERVIGRNRSPCMQDRSHMPYTDAVVHEVQRYIDLLPTSLPHAVTCDIKFRNYLIPKGTTILISLTSVLHDNKEFPNPEMFDPHHFLDEGGNFKKSKYFMPFSAGKRICVGEALAGMELFLFLTSILQNFNLKSLVDPKNLDTTPVVNGFASVPPFYQLCFIPV

SEQ ID NO: 815187 - protein, 490 aa, Homo sapiens [sequence omitted]

SEQ ID NO: 815188 - protein, 436 aa, Homo sapiens
MDSLVVLVLCLSCLLLLSLWRQSSGRGSIKDISKSLTNLSKVYGPVFTLYFGLKPIVVLHGYEAVKEALIDLGEEFSGRGIFPLAERANRGFGIVFSNGKKWKEIRRFSLMTLRNFGMGKRSIEDRVQEEARCLVEELRKTKASPCDPTFILGCAPCNVICSIIFHKRFDYKDQQFLNLMEKLNENIKILSSPWIQICNNFSPIIDYFPGTHNKLLKNVAFMKSYILEKVKEHQESMDMNNPQDFIDCFLMKMEKEKHNQPSEFTIESLVRYALLLLLKHPEVTAKVQEEIERVIGRNRSPCMQDRSHMPYTDAVVHEVQRYIDLLPTSLPHAVTCDIKFRNYLIPKGTTILISLTSVLHDNKEFPNPEMFDPHHFLDEGGNFKKSKYFMPFSAVTSILQNFNLKSLVDPKNLDTTPVVNGFASVPPFYQLCFIPV

SEQ ID NO: 815189 - protein, 454 aa, Homo sapiens
MDSLVVLVLCLSCLLLLSLWRQSSGRGSIKDISKSLTNLSKVYGPVFTLYFGLKPIVVLHGYEAVKEALIDLGEEFSGRGIFPLAERANRGFGIVFSNGKKWKEIRRFSLMTLRNFGMGKRSIEDRVQEEARCLVEELRKTKASPCDPTFILGCAPCNVICSIIFHKRFDYKDQQFLNLMEKLNENIKILSSPWIQICNNFSPIIDYFPGTHNKLLKNVAFMKSYILEKVKEHQESMDMNNPQDFIDCFLMKMEKEKHNQPSEFTIESLENTAVDLFGAGTETTSTTLRYALLLLLKHPEVTAKVQEEIERVIGRNRSPCMQDRSHMPYTDAVVHEVQRYIDLLPTSLPHAVTCDIKFRNYLIPKGTTILISLTSVLHDNKEFPNPEMFDPHHFLDEGGNFKKSKYFMPFSAVTSILQNFNLKSLVDPKNLDTTPVVNGFASVPPFYQLCFIPV

SEQ ID NO: 815190 - protein, 169 aa, Homo sapiens
MDSLVVLVLCLSCLLLLSLWRQSSGRGKLPPGPTPLPVIGNILQIGIKDISKSLTNLSKVYGPVFTLYFGLKPIVVLHGYEAVKEALIDLGEEFSGRGIFPLAERANRGFGIVFSNGKKWKEIRRFSLMTLRNFGMGKRSIEDRVQEEARCLVEELRKTKGVGDPTPYH

SEQ ID NO: 815191 - protein, 273 aa, Homo sapiens
MDSLVVLVLCLSCLLLLSLWRQSSGRGSIKDISKSLTNLSKVYGPVFTLYFGLKPIVVLHGYEAVKEALIDLGEEFSGRGIFPLAERANRGFGIVFSNGKKWKEIRRFSLMTLRNFGMGKRSIEDRVQEEARCLVEELRKTKASPCDPTFILGCAPCNVICSIIFHKRFDYKDQQFLNLMEKLNENIKILSSPWIQICNNFSPIIDYFPGTHNKLLKNVAFMKSYILEKVKEHQESMDMNNPQDFIDCFLMKMEKVKCKQKLSYVTACEFVIC

SEQ ID NO: 815192 - protein, 169 aa, Homo sapiens; identical to SEQ ID NO: 815190

SEQ ID NO: 815193 - protein, 512 aa, Homo sapiens
MTAPWVALALLWGSLWPGSGRGEAETRECIYYNANWELERTNQSGLERCEGEQDKRLHCYASWRNSSGTIELVKKGCWLDDFNCYDRQECVATEENPQVYFCCCEGNFCNERFTHLPEAGGPEVTYEPPPTAPTLLTVLAYSLLPIGGLSLIVLLAFWMYRHRKPPYGHVDIHEDPGPPPPSPLVGLKPLQLLEIKARGRFGCVWKAQLMNDFVAVKIFPLQDKQSWQSEREIFSTPGMKHENLLQFIAAEKRGSNLEVELWLITAFHDKGSLTDYLKGNIITWNELCHVAETMSRGLSYLHEDVPWCRGEGHKPSIAHRDFKSKNVLLKSDLTAVLADFGLAVRFEPGKPPGDTHGQVGTRRYMAPEVLEGAINFQRDAFLRIDMYAMGLVLWELVSRCKAADGPVDEYMLPFEEEIGQHPSLEELQEVVVHKKMRPTIKDHWLKHPGLAQLCVTIEECWDHDAEARLSAGCVEERVSLIRRSVNGTTSDCLVSLVTSVTNVDLPPKESSI

SEQ ID NO: 815194 - protein, 554 aa, Homo sapiens
VTFLVSLPSWVDKLRVEDTSDVNKMEIDIVQKKKQLEAESHAAQLQILMEFLKVARRNKREQLEQIQKELSVLEEDIKRVEEMSGLYSPVSEDSTVPQFEAPSPSHSSIIDSTEYSQPPGFSGSSQAGVQWRYLGSLQPPPPRYKRFSCLTLPSSWDYRRLPPHLTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 815195 - protein, 711 aa, Homo sapiens
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLVNELILKQKQRFEEKRFKLDHSVSSTNGHRWQIFQDWLGTDQDNLDLANVNLMLELLVQKKKQLEAESHAAQLQILMEFLKVARRNKREEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 815196 - protein, 770 aa, Homo sapiens
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLVNELILKQKQRFEEKRFKLDHSVSSTNGHRWQIFQDWLGTDQDNLDLANVNLMLELLVQKKKQLEAESHAAQLQILMEFLKVARRNKREQLEQIQKELSVLEEDIKRVEEMSGLYSPVSEDSTVPQFEAPSPSHSSIIDSTEYSQPPGFSGSSQAGVQWRYLGSLQPPPPRYKRFSCLTLPSSWDYRRLPPHLTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 815197 - protein, 570 aa, Homo sapiens [sequence omitted]

SEQ ID NO: 815198 - protein, 731 aa, Homo sapiens
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLVNELILKQKQRFEEKRFKLDHSVSSTNGHRWQIFQDWLGTDQDNLDLANVNLMLELLVQKKKQLEAESHAAQLQILMEFLKVARRNKREQLEQIQKELSVLEEDIKRVEEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 815199 - protein, 757 aa, Homo sapiens
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLVNELILKQKQRFEEGHRWQIFQDWLGTDQDNLDLANVNLMLELLVQKKKQLEAESHAAQLQILMEFLKVARRNKREQLEQIQKELSVLEEDIKRVEEMSGLYSPVSEDSTVPQFEAPSPSHSSIIDSTEYSQPPGFSGSSQAGVQWRYLGSLQPPPPRYKRFSCLTLPSSWDYRRLPPHLTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 815200 - protein, 749 aa, Homo sapiens
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLVNELILKQKQRFEEKRFKLDHSVSSTNGHRWQIFQDWLGTDQDNLDLANVNLMLELLVQKKKQLEAESHAAQLQILMEFLKVARRNKREQLEQIQKELSVLEEDIKRVEEMSGLYSPVSEDSTVPQFEAPSPSHSLEFSSDMHRIFVNGILIISIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 815201 - protein, 491 aa, Homo sapiens
MLWTILTICILISWESHAAQLQILMEFLKVARRNKREQLEQIQKELSVLEEDIKRVEEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 815202 - protein, 530 aa, Homo sapiens
MLELLVQKKKQLEAESHAAQLQILMEFLKVARRNKREQLEQIQKELSVLEEDIKRVEEMSGLYSPVSEDSTVPQFEAPSPSHSSIIDSTEYSQPPGFSGSSQAGVQWRYLGSLQPPPPRYKRFSCLTLPSSWDYRRLPPHLTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 815203 - protein, 463 aa, Homo sapiens
GWRSRGSRKQLEQIQKELSVLEEDIKRVEEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 815204 - protein, 457 aa, Homo sapiens
SRGSPCQSLWELSVLEEDIKRVEEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 815205 - protein, 437 aa, Homo sapiens
IIFYCRNHMQPNYRFLWNSSRLQEEIRESSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 815206 - protein, 770 aa, Homo sapiens; identical to SEQ ID NO: 815196

SEQ ID NO: 815207 - protein, 770 aa, Homo sapiens; identical to SEQ ID NO: 815196

SEQ ID NO: 815208 - protein, 172 aa, Homo sapiens
DSRGLPQSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 815209 - protein, 729 aa, Homo sapiens
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLVNELILKQKQRFEEKRFKLDHSVSSTNGHRWQIFQDWLGTDQDNLDLANVNLMLELLVQKKKQLEAESHAAQLQILMEFLKVARRNKREQLEQIQKELSVLEEDIKRVEEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANIQSVCPPLS

SEQ ID NO: 815210 - protein, 658 aa, Homo sapiens
MSGSRQAGSGSAGTSPGSSAASSVTSASSSLSSSPSPPSVAVSAAALVSGGVAQAAGSGGLGGPVRPVLVAPAVSGSGGGAVSTGLSRHSCAARPSAGVGGSSSSLGSGSRKRPLLAPLCNGLINSYEDKSNDFVCPICFDMIEEAYMTKCGHSFCYKCIHQSLEDNNRCPKCNYVVDNIDHLYPNFLVNELILKQKQRFEEKRFKLDHSVSSTNGHRWQIFQDWLGTDQDNLDLANVNLMLELLVQKKKQLEAESHAAQLQILMEFLKVARRNKREQLEQIQKELSVLEEDIKRVEEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACG

SEQ ID NO: 815211 - protein, 86 aa, Homo sapiens
MRLARLLRGAALAGPGPGLRAAGFSRSFSSDSGSSPASERGVPGQVDFYARFSPSPLSMKQFLDFGECGPGPWAFLRGPGRGAAAA

SEQ ID NO: 815212 - protein, 443 aa, Homo sapiens
IPAPAARHVPHVPLGRGAGKPGVLAVASLAGLGMRLARLLRGAALAGPGPGLRAAGFSRSFSSDSGSSPASERGVPGQVDFYARFSPSPLSMKQFLDFGSVNACEKTSFMFLRQELPVRLANIMKEISLLPDNLLRTPSVQLVQSWYIQSLQELLDFKDKSAEDAKAIYDFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNPFSYLQMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 815213 - protein, 329 aa, Homo sapiens
PARYPVQLVQSWYIQSLQELLDFKDKSAEDAKAIYERPRRTWLQVSSLCCMACKMIFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNPFSYLQMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 815214 - protein, 121 aa, Homo sapiens
MSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 815215 - protein, 108 aa, Homo sapiens
PARYPVQLVQSWYIQSLQELLDFKDKSAEDAKAIYERPRRTWLQVSSLCCMACKMIFTDTVIRIRNRHNDVIPTMAQGVIEYKESFGVDPVTSQNVHTLFIVFTKLFE

SEQ ID NO: 815216 - protein, 443 aa, Homo sapiens; identical to SEQ ID NO: 815212

SEQ ID NO: 815217 - protein, 469 aa, Homo sapiens
IPAPAARHVPHVPLGRGAGKPGVLAVASLAGLGMRLARLLRGAALAGPGPGLRAAGFSRSFSSDSGSSPASERGVPGQVDFYARFSPSPLSMKQFLDFGSVNACEKTSFMFLRQELPVRLANIMKEISLLPDNLLRTPSVQLVQSWYIQSLQELLDFKDKSAEDAKAIYDFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNAMRATMEHHANRGVYPPIQVHVTLGNEDLTVKMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 815218 - protein, 456 aa, Homo sapiens
IPAPAARHVPHVPLGRGAGKPGVLAVASLAGLGMRLARLLRGAALAGPGPGLRAAGFSRSFSSDSGSSPASERGVPGQVDFYARFSPSPLSMKQFLDFGSVNACEKTSFMFLRQELPVRLANIMKEISLLPDNLLRTPSVQLVQSWYIQSLQELLDFKDKSAEDAKAIYDFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNAMRATMEHHANRGVYPPIQVHVTLGNEDLTVKMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVP

SEQ ID NO: 815219 - protein, 86 aa, Homo sapiens; identical to SEQ ID NO: 815211

SEQ ID NO: 815220 - protein, 436 aa, Homo sapiens
MRLARLLRGAALAGPGPGLRAAGFSRSFSSDSGSSPASERGVPGQVDFYARFSPSPLSMKQFLDFGSVNACEKTSFMFLRQELPVRLANIMKEISLLPDNLLRTPSVQLVQSWYIQSLQELLDFKDKSAEDAKAIYDFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNAMRATMEHHANRGVYPPIQVHVTLGNEDLTVKMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 815221 - protein, 430 aa, Homo sapiens
MRLARLLRGAALAGPGPGLRAAGFSRSFSSDSGSSPASERGVPGQVDFYARFSPSPLSMKQFLDFGSVNACEKTSFMFLRQELPVRLANIMKEISLLPDNLLRTPSVQLVQSWYIQSLQELLDFKDKSAEDAKAIYERPRRTWLQVSSLCCMACKMIFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNPFSYLKMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 815222 - protein, 443 aa, Homo sapiens; identical to SEQ ID NO: 815212

SEQ ID NO: 815223 - protein, 436 aa, Homo sapiens; identical to SEQ ID NO: 815220

SEQ ID NO: 815224 - protein, 469 aa, Homo sapiens; identical to SEQ ID NO: 815217

SEQ ID NO: 815225 - protein, 41 aa, Homo sapiens
NHQKGNSRGNVFRYCSSDCFVHVTIALKPSTVLRNEYRVST

SEQ ID NO: 815226 - protein, 532 aa, Homo sapiens
MEKSNETNGYLDSAQAGPAAGPGAPGTAAGRARRCAGFLRRQALVLLTVSGVLAGAGLGAALRGLSLSRTQVTYLAFPGEMLLRMLRMIILPLVVCSLVSGAASLDASCLGRLGGIAVAYFGLTTLSASALAVALAFIIKPGSGAQTLQSSDLGLEDSGPPPVPKETVDSFLDLARNLFPSNLVVAAFRTYATDYKVVTQNSSSGNVTHEKIPIGTEIEGMNILGLVLFALVLGVALKKLGSEGEDLIRFFNSLNEATMVLVSWIMWYVPVGIMFLVGSKIVEMKDIIVLVTSLGKYIFASILGHVIHGGIVLPLIYFVFTRKNPFRFLLGLLAPFATAFATCSSSATLPSMMKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 815227 - protein, 180 aa, Homo sapiens
MKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 815228 - protein, 532 aa, Homo sapiens; identical to SEQ ID NO: 815226

SEQ ID NO: 815229 - protein, 532 aa, Homo sapiens; identical to SEQ ID NO: 815226

SEQ ID NO: 815230 - protein, 532 aa, Homo sapiens; identical to SEQ ID NO: 815226

SEQ ID NO: 815231 - protein, 532 aa, Homo sapiens; identical to SEQ ID NO: 815226

SEQ ID NO: 815232 - protein, 663 aa, Homo sapiens
MSARLPVLSPPRWPRLLLLSLLLLGAVPGPRRSGAFYLPGLAPVNFCDEEKKSDECKAEIELFVNRLDSVESVLPYEYTAFDFCQASEGKRPSENLGQVLFGERIEPSPYKFTFNKKETCKLVCTKTYHTEKAEDKQKLEFLKKSMLLNYQHHWIVDNMPVTWCYDVEDGQRFCNPGFPIGCYITDKGHAKDACVISSDFHERDTFYIFNHVDIKIYYHVVETGSMGARLVAAKLEPKSFKHTHIDKPDCSGPPMDISNKASGEIKIAYTYSVSFEEDDKIRWASRWDYILESMPHTHIQWFSIMNSLVIVLFLSGMVAMIMLRTLHKDIARYNQMDSTEDAQEEFGWKLVHGDIFRPPRKGMLLSVFLGSGTQILIMTFVTLFFACLGFLSPANRGALMTCAVVLWVLLGTPAGYVAARFYKSFGGEKWKTNVLLTSFLCPGIVFADFFIMNLILWGEGSSAAIPFGTLVAILALWFCISVPLTFIGAYFGFKKNAIEHPVRTNQIPRQIPEQSFYTKPLPGIIMGGILPFGCIFIQLFFILNSIWSHQMYYMFGFLFLVFIILVITCSEATILLCYFHLCAEDYHWQWRSFLTSGFTAVYFLIYAVHYFFSKLQITGTASTILYFGYTMIMVLIFFLFTGTIGFFACFWFVTKIYSVVKVD

SEQ ID NO: 815233 - protein, 663 aa, Homo sapiens; identical to SEQ ID NO: 815232

SEQ ID NO: 815234 - protein, 663 aa, Homo sapiens; identical to SEQ ID NO: 815232

SEQ ID NO: 815235 - protein, 303 aa, Homo sapiens
MSARLPVLSPPRWPRLLLLSLLLLGAVPGPRRSGAFYLPGLAPVNFCDEEKKSDECKAEIELFVNRLDSVESVLPYEYTAFDFCQASEGKRPSENLGQVLFGERIEPSPYKFTFNKKETCKLVCTKTYHTEKAEDKQKLEFLKKSMLLNYQHHWIVDNMPVTWCYDVEDGQRFCNPGFPIGCYITDKGHAKDACVISSDFHERDTFYIFNHVDIKIYYHVVETGSMGARLVAAKLEPKSFKHTHIDKPDCSGPPMDISNKASGEIKIAYTYSVSFEEDDKIRWASRWDYILESMPHTHIQWFR

SEQ ID NO: 815236 - protein, 644 aa, Homo sapiens
MSARLPVLSPPRWPRLLLLSLLLLGAVPGPRRSGAFYLPGLAPVNFCDEEKKSDECKAEIELFVNRLDSVESVLPYEYTAFDFCQASEGKRPSENLGQVLFGERIEPSPYKFTFNKKETCKLVCTKTYHTEKAEDKQKLEFLKWCYDVEDGQRFCNPGFPIGCYITDKGHAKDACVISSDFHERDTFYIFNHVDIKIYYHVVETGSMGARLVAAKLEPKSFKHTHIDKPDCSGPPMDISNKASGEIKIAYTYSVSFEEDDKIRWASRWDYILESMPHTHIQWFSIMNSLVIVLFLSGMVAMIMLRTLHKDIARYNQMDSTEDAQEEFGWKLVHGDIFRPPRKGMLLSVFLGSGTQILIMTFVTLFFACLGFLSPANRGALMTCAVVLWVLLGTPAGYVAARFYKSFGGEKWKTNVLLTSFLCPGIVFADFFIMNLILWGEGSSAAIPFGTLVAILALWFCISVPLTFIGAYFGFKKNAIEHPVRTNQIPRQIPEQSFYTKPLPGIIMGGILPFGCIFIQLFFILNSIWSHQMYYMFGFLFLVFIILVITCSEATILLCYFHLCAEDYHWQWRSFLTSGFTAVYFLIYAVHYFFSKLQITGTASTILYFGYTMIMVLIFFLFTGTIGFFACFWFVTKIYSVVKVD

SEQ ID NO: 815237 - protein, 663 aa, Homo sapiens; identical to SEQ ID NO: 815232

SEQ ID NO: 815238 - protein, 642 aa, Homo sapiens
RTVCKSTVVYSSVLGLHIHSPLTHPEQLPALQVLFMAEIELFVNRLDSVESVLPYEYTAFDFCQASEGKRPSENLGQVLFGERIEPSPYKFTFNKKETCKLVCTKTYHTEKAEDKQKLEFLKKSMLLNYQHHWIVDNMPVTWCYDVEDGQRFCNPGFPIGCYITDKGHAKDACVISSDFHERDTFYIFNHVDIKIYYHVVETGSMGARLVAAKLEPKSFKHTHIDKPDCSGPPMDISNKASGEIKIAYTYSVSFEEDDKIRWASRWDYILESMPHTHIQWFSIMNSLVIVLFLSGMVAMIMLRTLHKDIARYNQMDSTEDAQEEFGWKLVHGDIFRPPRKGMLLSVFLGSGTQILIMTFVTLFFACLGFLSPANRGALMTCAVVLWVLLGTPAGYVAARFYKSFGGEKWKTNVLLTSFLCPGIVFADFFIMNLILWGEGSSAAIPFGTLVAILALWFCISVPLTFIGAYFGFKKNAIEHPVRTNQIPRQIPEQSFYTKPLPGIIMGGILPFGCIFIQLFFILNSIWSHQMYYMFGFLFLVFIILVITCSEATILLCYFHLCAEDYHWQWRSFLTSGFTAVYFLIYAVHYFFSKLQITGTASTILYFGYTMIMVLIFFLFTGTIGFFACFWFVTKIYSVVKVD

SEQ ID NO: 815239 - protein, 645 aa, Homo sapiens
MSARLPVLSPPRWPRLLLLSLLLLGAVPGPRRSGAFYLPGLAPVNFCDEETVESVLPYEYTAFDFCQASEGKRPSENLGQVLFGERIEPSPYKFTFNKKETCKLVCTKTYHTEKAEDKQKLEFLKKSMLLNYQHHWIVDNMPVTWCYDVEDGQRFCNPGFPIGCYITDKGHAKDACVISSDFHERDTFYIFNHVDIKIYYHVVETGSMGARLVAAKLEPKSFKHTHIDKPDCSGPPMDISNKASGEIKIAYTYSVSFEEDDKIRWASRWDYILESMPHTHIQWFSIMNSLVIVLFLSGMVAMIMLRTLHKDIARYNQMDSTEDAQEEFGWKLVHGDIFRPPRKGMLLSVFLGSGTQILIMTFVTLFFACLGFLSPANRGALMTCAVVLWVLLGTPAGYVAARFYKSFGGEKWKTNVLLTSFLCPGIVFADFFIMNLILWGEGSSAAIPFGTLVAILALWFCISVPLTFIGAYFGFKKNAIEHPVRTNQIPRQIPEQSFYTKPLPGIIMGGILPFGCIFIQLFFILNSIWSHQMYYMFGFLFLVFIILVITCSEATILLCYFHLCAEDYHWQWRSFLTSGFTAVYFLIYAVHYFFSKLQITGTASTILYFGYTMIMVLIFFLFTGTIGFFACFWFVTKIYSVVKVD

SEQ ID NO: 815240 - protein, 518 aa, Homo sapiens [sequence omitted]

SEQ ID NO: 815241 - protein, 409 aa, Homo sapiens [sequence omitted]

SEQ ID NO: 815242 - protein, 658 aa, Homo sapiens
MSARLPVLSPPRWPRLLLLSLLLLGAVPGPRRSGAFYLPGLAPVNFCDEEKKSDECKAEIELFVNRLDSVESVLPYEYTAFDFCQASEGKRPSENLGQVLFGERIEPSPYKFTFNKKETCKLVCTKTYHTEKAEDKQKLEFLKKSMLLNYQHHWIVDNMPVTWCYDVEDGQRFCNPGFPIGCYITDKGHAKDACVISSDFHERDTFYIFNHVDIKIYYHVVETGSMGARLVAAKLEPKSFKHTHIDKPDCSGPPMDISNKASGEIKIAYTYSVSFEEDDKIRWASRWDYILESMPHTHIQWFSIMNSLVIVLFLSGMVAMIMLRTLHKDIARYNQMDSTEDAQEEFGWKLVHGDIFRPPRKGMLLSVFLGSGTQILIMTFVTLFFACLGFLSPANRGALMTCAVVLWVLLGTPAGYVAARFYKSFGGEKWKTNVLLTSFLCPGIVFADFFIMNLILWGEGSSAAIPFGTLVAILALWFCISVPLTFIGAYFGFKKNAIEHPVRTNQIPRQIPEQSFYTKPLPGILPFGCIFIQLFFILNSIWSHQMYYMFGFLFLVFIILVITCSEATILLCYFHLCAEDYHWQWRSFLTSGFTAVYFLIYAVHYFFSKLQITGTASTILYFGYTMIMVLIFFLFTGTIGFFACFWFVTKIYSVVKVD

SEQ ID NO: 815243 - protein, 602 aa, Homo sapiens
MSARLPVLSPPRWPRLLLLSLLLLGAVPGPRRSGAFYLPGLAPVNFCDEEKKSDECKAEIELFVNRLDSVESVLPYEYTAFDFCQASEGKRPSENLGQVLFGERIEPSPYKFTFNKKETCKLVCTKTYHTEKAEDKQKLEFLKKSMLLNYQHHWIVDNMPVTWCYDVEDGQRFCNPGFPIGCYITDKGHAKDACVISSDFHERDTFYIFNHVDIKIYYHVVETGSMGARLVAAKLEPKSFKHTHIDKPDCSGPPMDISNKASGEIKIAYTYSVSFEEDDKIRWASRWDYILESMPHTHIQWFSIMNSLVIVLFLSGMVAMIMLRTLHKDIARYNQMDSTEDAQEEFGWKLVHGDIFRPPRKGMLLSVFLGSGTQILIMTFVTLFFACLGFLSPANRGALMTCAVVLWVLLGTPAGYVAARFYKSFGGEKWKTNVLLTSFLCPGIVFADFFIMNLILWGEGSSAAIPFGTLVAILALWFCISVPLTFIGAYFGFKKNAIEHPVRTNQIPRQIPEQSFYTKPLPGIIMGGILPFGCIFIQLFFILNSIWSHQMYYMFGFLFLVFIILVITCSEATILLCYFHLCAEEQLASLHAFGLLPKYTVW

SEQ ID NO: 815244 - protein, 212 aa, Homo sapiens [sequence omitted]

SEQ ID NO: 815245 - protein, 663 aa, Homo sapiens; identical to SEQ ID NO: 815232

SEQ ID NO: 815246 - protein, 138 aa, Homo sapiens
MGGILPFGCIFIQLFFILNSIWSHQMYYMFGFLFLVFIILVITCSEATILLCYFHLCAEDYHWQWRSFLTSGFTAVYFLIYAVHYFFSKLQITGTASTILYFGYTMIMVLIFFLFTGTIGFFACFWFVTKIYSVVKVD

SEQ ID NO: 815247 - protein, 131 aa, Homo sapiens
MTWTHYPLVPPWAFAWNGRIPGNPGQPRLPAPPKGPCKLALLKLFLETWRQLPRLETVDGEPSLEDLEESTTCLGTRDGFQPCLEDPEGIMLTFPCSFKVYNSRNSVPGKKAWDHLNHCSNIQFLSNFLVN

SEQ ID NO: 815248 - protein, 602 aa, Homo sapiens
ASRMRRARSREGMAGAVPGAIMDEDYYGSAAEWGDEADGGQQEDDSGEGEDDAEVQQECLHKFSTRDYIMEPSIFNTLKRYFQAGGSPENVIQLLSENYTAVAQTVNLLAEWLIQTGVEPVQVQETVENHLKSLLIKHFDPRKADSIFTEEGETPAWLEQMIAHTTWRDLFYKLAEAHPDCLMLNFTVKLISDAGYQGEITSVSTACQQLEVFSRVLRTSLATILDGGEENLEKNLPEFAKMVCHGEHTYLFAQAMMSVLAQEEQGGSAVRRIAQEVQRFAQEKGHDASQITLALGTAASYPRACQALGAMLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRGYVLPVVSYIRKCLEKLDTDISLIRYFVTEVLDVIAPPYTSDFVQLFLPILENDSIAGTIKTEGEHDPVTEFIAHCKSNFIMVN

SEQ ID NO: 815249 - protein, 420 aa, Homo sapiens
MLNFTVKLISDAGYQGEITSVSTACQQLEVFSRVLRTSLATILDGGEENLEKNLPEFAKMVCHGEHTYLFAQAMMSVLAQEEQGGSAVRRIAQEVQRFAQEKGHDASQITLALGTAASYPRACQALGAMLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRGYVLPVVSYIRKCLEKLDTDISLIRYFVTEVLDVIAPPYTSDFVQLFLPILENDSIAGTIKTEGEHDPVTEFIAHCKSNFIMVN

SEQ ID NO: 815250 - protein, 361 aa, Homo sapiens
MVCHGEHTYLFAQAMMSVLAQEEQGGSAVRRIAQEVQRFAQEKGHDASQITLALGTAASYPRACQALGAMLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRGYVLPVVSYIRKCLEKLDTDISLIRYFVTEVLDVIAPPYTSDFVQLFLPILENDSIAGTIKTEGEHDPVTEFIAHCKSNFIMVN

SEQ ID NO: 815251 - protein, 133 aa, Homo sapiens
EHDPVTEFIAHCKSKLVHHDEVRFAVSYKLRHRVMLAFRFDGTCDAVILQNILLLAVPGAIMDEDYYGSAAEWGDEADGGQQEDDSGEGEDDAEVQQECLHKFSTRDYIMEPSIFNTLKRYVRKVSVLGGGWG

SEQ ID NO: 815252 - protein, 387 aa, Homo sapiens
MLNFTVKLISDAGYQGEITSVSTACQQLEVFSRVLRTSLATILDGGEENLEKNLPEFAKMVCHGEHTYLFAQAMMSVLAQEEQGGSAVRRIAQEVQRFAQEKGHDASQITLALGTAASYPRACQALGAMLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRGYVLPVVSYIRKCLEKLDTDISLIRYFVTEVSNAPLVSCFILFTLALPFLA

SEQ ID NO: 815253 - protein, 133 aa, Homo sapiens; identical to SEQ ID NO: 815251

SEQ ID NO: 815254 - protein, 292 aa, Homo sapiens
MLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRGYVLPVVSYIRKCLEKLDTDISLIRYFVTEVLDVIAPPYTSDFVQLFLPILENDSIAGTIKTEGEHDPVTEFIAHCKSNFIMVN

SEQ ID NO: 815255 - protein, 312 aa, Homo sapiens
MVCHGEHTYLFAQAMMSVLAQEEQGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRGYVLPVVSYIRKCLEKLDTDISLIRYFVTEVLDVIAPPYTSDFVQLFLPILENDSIAGTIKTEGEHDPVTEFIAHCKSNFIMVN

SEQ ID NO: 815256 - protein, 133 aa, Homo sapiens; identical to SEQ ID NO: 815251

SEQ ID NO: 815257 - protein, 133 aa, Homo sapiens; identical to SEQ ID NO: 815251

SEQ ID NO: 815258 - protein, 347 aa, Homo sapiens
MLNFTVKLISDAGYQGEITSVSTACQQLEVFSRVLRTSLATILDGGEENLEKNLPEFAKMVCHGEHTYLFAQAMMSVLAQEEQGGSAVRRIAQEVQRFAQEKGHDASQITLALGTAASYPRACQALGAMLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRGAGRHCSSLYL

SEQ ID NO: 815259 - protein, 350 aa, Homo sapiens
MVCHGEHTYLFAQAMMSVLAQEEQGGSAVRRIAQEVQRFAQEKGHDASQITLALGTAASYPRACQALGAMLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEVLQLLVKLFETEHSQLDVMEQLELKKTLLDRMVHLLSRGYVLPVVSYIRKCLEKLDTDISLIRYFVTEVLDVIAPPYTSDFVQLFLPILENDSIAGTIKTEGEHDPVTEFIAHCKSNFIMVN

SEQ ID NO: 815260 - protein, 420 aa, Homo sapiens; identical to SEQ ID NO: 815249

SEQ ID NO: 815261 - protein, 387 aa, Homo sapiens; identical to SEQ ID NO: 815252

SEQ ID NO: 815262 - protein, 420 aa, Homo sapiens; identical to SEQ ID NO: 815249

SEQ ID NO: 815263 - protein, 420 aa, Homo sapiens; identical to SEQ ID NO: 815249

SEQ ID NO: 815264 - protein, 420 aa, Homo sapiens; identical to SEQ ID NO: 815249

SEQ ID NO: 815265 - protein, 420 aa, Homo sapiens; identical to SEQ ID NO: 815249

SEQ ID NO: 815266 - protein, 387 aa, Homo sapiens; identical to SEQ ID NO: 815252

SEQ ID NO: 815267 - protein, 387 aa, Homo sapiens; identical to SEQ ID NO: 815252

SEQ ID NO: 815268 - protein, 347 aa, Homo sapiens; identical to SEQ ID NO: 815258

SEQ ID NO: 815269 - protein, 387 aa, Homo sapiens; identical to SEQ ID NO: 815252

SEQ ID NO: 815270 - protein, 399 aa, Homo sapiens
MLNFTVKLISDAGYQGEITSVSTACQQLEVFSRVLRTSLATILDGGEENLEKNLPEFAKMVCHGEHTYLFAQAMMSVLAQEEQGGSAVRRIAQEVQRFAQEKGHDASQITLALGTAASYPRACQALGAMLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRGYVLPVVSYIRKCLEKLDTDISLIRYFVTEVSNAPLAVSRGPLGTPLGELLSKLTSVFSQEPS

SEQ ID NO: 815271 - protein, 371 aa, Homo sapiens
MLNFTVKLISDAGYQGEITSVSTACQQLEVFSRVLRTSLATILDGGEENLEKNLPEFAKMVCHGEHTYLFAQAMMSVLAQEEQGGSAVRRIAQEVQRFAQEKGHDASQITLALGTAASYPRACQALGAMLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRELDVIAPPYTSDCGSRRGSQESECVHKSPIKKAAP

SEQ ID NO: 815272 - protein, 133 aa, Homo sapiens; identical to SEQ ID NO: 815251

SEQ ID NO: 815273 - protein, 253 aa, Homo sapiens
PVVSVSLPCQQKMAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSS

SEQ ID NO: 815274 - protein, 352 aa, Homo sapiens
TLSRAGPGGGARRAGRAGGEAGPRRRRPRRPALGPAARSAPLPGSAPCLRVAAPAVAASEPAATSSEQKMAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 815275 - protein, 352 aa, Homo sapiens; identical to SEQ ID NO: 815274

SEQ ID NO: 815276 - protein, 283 aa, Homo sapiens
MAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 815277 - protein, 313 aa, Homo sapiens
VGNLVLNGEGLAPVSPAYPLRARRTSSEQKMAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 815278 - protein, 335 aa, Homo sapiens
RKRTPASLRPGRRGPGPWGAEREALREERARGPGSPAAGRDRERPARAWLQKMAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 815279 - protein, 259 aa, Homo sapiens
CSVASLGGAKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 815280 - protein, 304 aa, Homo sapiens
AGCSQPPFPEPAATSSEKMAVPPTYRFLAKSARDVFTKGYGFGLITTGPGNLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 815281 - protein, 210 aa, Homo sapiens
PVINGCYTEARDFVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 815282 - protein, 219 aa, Homo sapiens
MAWVNRSLSGKKFPTECQYVVDHASQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 815283 - protein, 203 aa, Homo sapiens
MRGFCDSRDVHSLTFSDSIRFLNLNNFGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 815284 - protein, 375 aa, Homo sapiens
TLSRAGPGGGARRAGRAGGEAGPRRRRPRRPALGPAARSAPLPGSAPCLRVAAPAVAASEPAATSSEQKMAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKHVVFGKVKEGMNIVEAMERFGSRNGKTSKKITIADCGQLE

SEQ ID NO: 815285 - protein, 194 aa, Homo sapiens
PEGGNSRGTRYQIQKRKCNHGKLNQWWILEPGFQARANLVDLMKALSEYFPWYDSLVSKKLSPEVSSIGFGDTKVISLESTMGKDGLDFCQHVMKNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 815286 - protein, 283 aa, Homo sapiens
TLSRAGPGGGARRAGRAGGEAGPRRRRPRRPALGPAARSAPLPGSAPCLRVAAPAVAASEPAATSSEQKMAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVWTVYEIDDRFHGKKKEVACQKSLDSVTVPD

SEQ ID NO: 815287 - protein, 118 aa, Homo sapiens
MAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGV

SEQ ID NO: 815288 - protein, 115 aa, Homo sapiens
MAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGPHHECKA

SEQ ID NO: 815289 - protein, 148 aa, Homo sapiens [sequence omitted]

SEQ ID NO: 815290 - protein, 633 aa, Homo sapiens
MPSCGACTCGAAAVRLITSSLASAQRGISGGRIHMSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQKPPPPPKKIYNYLDKYVVGQSFAKKVLSVAVYNHYKRIYNNIPANLRQQAEVEKQTSLTPRELEIRRREDEYRFTKLLQIAGISPHGNALGASMQQQVNQQIPQEKRGGEVLDSSHDDIKLEKSNILLLGPTGSGKTLLAQTLAKCLDVPFAICDCTTLTQAGYVGEDIESVIAKLLQDANYNVEKAQQGIVFLDEVDKIGSVPGIHQLRDVGGEGVQQGLLKLLEGTIVNVPEKNSRKLRGETVQVDTTNILFVASGAFNGLDRIISRRKNEKYLGFGTPSNLGKGRRAAAAADLANRSGESNTHQDIEEKDRLLRHVEARDLIEFGMIPEFVGRLPVVVPLHSLDEKTLVQILTEPRNAVIPQYQALFSMDKCELNVTEDALKAIARLALERKTGARGLRSIMEKLLLEPMFEVPNSDIVCVEVDKEVVEGKKEPGYIRAPTKESSEEEYDSGVEEEGWPRQADAANS

SEQ ID NO: 815291 - protein, 582 aa, Homo sapiens
MPSCGACTCGAAAVRLITSSLASAQRGISGGRIHMSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQKPPPPPKKIYNYLDKYVVGQSFAKKVLSVAVYNHYKRIYNNIPANLRQQAEVEKQTSLTPRELEIRRREDEYRFTKLLQIAGISPHGNALGASMQQQVNQQIPQEKRGGEVLDSSHDDIKLEKSNILLLGPTGSGKTLLAQTLAKCLDVPFAICDCTTLTQAGYVGEDIESVIAKLLQDANYNVEKAQQGIVFLDEVDKIGSVPGIHQLRDVGGEGVQQGLLKLLEGTIVNVPEKNSRKLRGETVQVDTTNILFVASGAFNGLDRIISRRKNEKYLGFGTPSNLGKGRRAAAAADLANRSGESNTHQDIEEKDRLLRHVEARDLIEFGMIPEFVGRLPVVVPLHSLDEKTLVQILTDHHTRPYLPSLIHFSTMGEYMELKSGLNLQKVIYLFYFIFLRQSLAVSPRLEYSATILAHCNL

SEQ ID NO: 815292 - protein, 385 aa, Homo sapiens
MPSCGACTCGAAAVRLITSSLASAQRGISGGRIHMSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQKPPPPPKKIYNYLDKYVVGQSFAKKVLSVAVYNHYKRIYNNIPANLRQQAEVEKQTSLTPRELEIRRREDEYRFTKLLQIAGISPHGNALGASMQQQVNQQIPQEKRGGEVLDSSHDDIKLEKSNILLLGPTGSGKTLLAQTLAKCLDVPFAICDCTTLTQAGYVGEDIESVIAKLLQDANYNVEKAQQGIVFLDEVDKIGSVPGIHQLRDVGGEGVQQVSS

SEQ ID NO: 815293 - protein, 153 aa, Homo sapiens
MVINKYLLLHWMLLKHYHVGCSSNLKQQVNQQIPQEKRGGEVLDSSHDDIKLEKSNILLLGPTGSGKTLLAQTLAKCLDVPFAICDCTTLTQAGYVGEDIESVIAKLLQDANYNVEKAQQGIVFLDEVDKIGSVPGIHQLRDVGGEGVQQVSS

SEQ ID NO: 815294 - protein, 582 aa, Homo sapiens; identical to SEQ ID NO: 815291

SEQ ID NO: 815295 - protein, 582 aa, Homo sapiens; identical to SEQ ID NO: 815291

SEQ ID NO: 815296 - protein, 401 aa, Homo sapiens
TGVTPVLNLETKQNFKVHQNRTSLKHKSHGGRQWSHLEGLAASGRSHRPRPTMAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTGELHAGMWVMSPGRGHEEHWSRNQDIPALVLPPATNTLNALCGLEPVTTLSGPLSNSHPSSGC

SEQ ID NO: 815297 - protein, 245 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDRCLLDLGHTRDG

SEQ ID NO: 815298 - protein, 144 aa, Homo sapiens
MQQLPATNQIHITTTNRKRRRHARRIKAERKATNTQGAAARSKTEHLQKRNQNHDNEAKEELNRRDTHTGRRKKHQSKEDGEAKTESEEAQAHEREHKGDQDNVTNKRQHKTKTNKQRQTAITTQKRENSKKTRRNTATLPRDR

SEQ ID NO: 815299 - protein, 739 aa, Homo sapiens
TGVTPVLNLETKQNFKVHQNRTSLKHKSHGGRQWSHLEGLAASGRSHRPRPTMAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 815300 - protein, 687 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 815301 - protein, 687 aa, Homo sapiens; identical to SEQ ID NO: 815300

SEQ ID NO: 815302 - protein, 847 aa, Homo sapiens
TGVTPVLNLETKQNFKVHQNRTSLKHKSHGGRQWSHLEGLAASGRSHRPRPTMAEELVLERCDLELETNGRDHHTADLCREKLVVRRGQPFWLTLHFEGRNYEASVDSLTFSVVTESDQPLLALPMTQTCLWGRALPSTWKSSCFESVPITVPLRTRLGSVLFGKKRHRRRQLRAKDPLQMRPLPQTPRISLGDRFALSLSFLTWARGLKGSRCFMKCKRLYEGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 815303 - protein, 578 aa, Homo sapiens
MQAPQHCAGHGGEDPALAILDALAEVVLPAPQDVHAADPGHGADAVPELYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 815304 - protein, 656 aa, Homo sapiens
TGVTPVLNLETKQNFKVHQNRTSLKHKSHGGRQWSHLEGLAASGRSHRPRPTMAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRNWW

SEQ ID NO: 815305 - protein, 739 aa, Homo sapiens; identical to SEQ ID NO: 815299

SEQ ID NO: 815306 - protein, 335 aa, Homo sapiens
ERLMPVPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 815307 - protein, 343 aa, Homo sapiens
TSSRSQCVSSLIGRPSLQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 815308 - protein, 332 aa, Homo sapiens
MAHPFPFLPLPGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 815309 - protein, 707 aa, Homo sapiens
TGVTPVLNLETKQNFKVHQNRTSLKHKSHGGRQWSHLEGLAASGRSHRPRPTMAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVPETVGALTLADWGWGERGKTYIPSPAQMPFGKPLTTHHIV

SEQ ID NO: 815310 - protein, 206 aa, Homo sapiens
SSLGTLEPQWGVQGSAQPFPRCVTPSTFLPLSVPLGVARELGGVILHHEHPPFSPSAEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 815311 - protein, 154 aa, Homo sapiens
MTRISEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 815312 - protein, 739 aa, Homo sapiens; identical to SEQ ID NO: 815299

SEQ ID NO: 815313 - protein, 739 aa, Homo sapiens; identical to SEQ ID NO: 815299

SEQ ID NO: 815314 - protein, 124 aa, Homo sapiens
HALGVKSATHPGMLLSNGADSLTSLGFVTAVTERVVLKPLRVGIQFCCSPPHRESVDALSVEGAGLTEEQKTVEIPDPVEAGEEVKVRMDLLPLHMGLHKLVVNFESDKLKAVKGFRNVIIGPA

SEQ ID NO: 815315 - protein, 254 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQSRKWNVPLAHLSLLSLWVPTHPLCCEECSVPETVGALTLADWGWGERGKTYIPSPAQMPFGKPLTTHHIV

SEQ ID NO: 815316 - protein, 739 aa, Homo sapiens; identical to SEQ ID NO: 815299

SEQ ID NO: 815317 - protein, 739 aa, Homo sapiens; identical to SEQ ID NO: 815299

SEQ ID NO: 815318 - protein, 739 aa, Homo sapiens; identical to SEQ ID NO: 815299

SEQ ID NO: 815319 - protein, 660 aa, Homo sapiens
TGVTPVLNLETKQNFKVHQNRTSLKHKSHGGRQWSHLEGLAASGRSHRPRPTMAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRDPLHSMFAMLLYGPAL

SEQ ID NO: 815320 - protein, 739 aa, Homo sapiens; identical to SEQ ID NO: 815299

SEQ ID NO: 815321 - protein, 127 aa, Homo sapiens
SSLGTLEPQWGVQGSAQPFPRCVTPSTFLPLSVPLGVARELGGVILHHEHPPFSPSAEKSVPLCILYEKYRDCLTESNLIKVRALLVEPVINSYLLAERDLYLENPEIKIRDPLHSMFAMLLYGPAL

SEQ ID NO: 815322 - protein, 739 aa, Homo sapiens; identical to SEQ ID NO: 815299

SEQ ID NO: 815323 - protein, 600 aa, Homo sapiens
TGVTPVLNLETKQNFKVHQNRTSLKHKSHGGRQWSHLEGLAASGRSHRPRPTMAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSGKALCSWSIC

SEQ ID NO: 815324 - protein, 600 aa, Homo sapiens; identical to SEQ ID NO: 815323

SEQ ID NO: 815325 - protein, 690 aa, Homo sapiens
TGVTPVLNLETKQNFKVHQNRTSLKHKSHGGRQWSHLEGLAASGRSHRPRPTMAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEM

SEQ ID NO: 815326 - protein, 109 aa, Homo sapiens
MLWRRVTGQPPWWTSKTAPSRCSSPPRPTPPSACIASAWRPPLATRDPALCWATSFCSSTPGAQRMLCTWTRKRSGRSMSSPSRALSTRARPSSSRTYLGILGSLKMGS

SEQ ID NO: 815327 - protein, 595 aa, Homo sapiens
TGVTPVLNLETKQNFKVHQNRTSLKHKSHGGRQWSHLEGLAASGRSHRPRPTMAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNHIMHDVICHNSEVHGPRDVETSVYPCIMCRKPECVLISGSQTGLL

SEQ ID NO: 815328 - protein, 501 aa, Homo sapiens
TGVTPVLNLETKQNFKVHQNRTSLKHKSHGGRQWSHLEGLAASGRSHRPRPTMAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVVTNYNSAHDQNSNLLIEY

SEQ ID NO: 815329 - protein, 102 aa, Homo sapiens
AASGRTWRVSPPVEGATAPARPWPRVSIRVTAAATQGPRGIGGQDPVGAESLSPDLESNRQTGLGEEASQCCLEPQFPHPHCITINPCLPGSGEAMERDGVL

SEQ ID NO: 815330 - protein, 103 aa, Homo sapiens
CLTESNLIKVRALLVEPVINSYLLAERDLYLENPEIKIRGKGRLGKGQGPRAAQRWGEGRSLPPPHTPASLQAPDLWCLSDPQILASSKKSIMKPRELGTRSL

SEQ ID NO: 815331 - protein, 103 aa, Homo sapiens
RPPKALRRPALSPPSSTERMKEHGKRKTHRTPQRSFENWAVWLSHHPFGHQLWSQLLCPRGMHYGPERGPCPFLGCHPGWVVWISAVNMAHLGEAQVPRFEQL

SEQ ID NO: 815332 - protein, 300 aa, Homo sapiens
RRFLFRRQEEPRAAGAVAAAALAAVSQAAPASSGPSPSDPSPLLDPTAVSDIAGKMSDEFSLADALPEHSPAKTSAVSNTKPGQPPQGWPGSNPWNNPSAPSSVPSGLPPSATPSTVPFGPAPTGMYPSVPPTGPPPGPPAPFPPSGPSCPPPGGPYPAPTVPGPGPTGPYPTPNMPFPELPRPYGAPTDPAAAGPLGPWGSMSSGPWAPGMGGQYPTPNMPYPSPGPYPAPPPPQAPGAAPPVPWGTVPPGAWGPPAPYPAPTGSYPTPGLYPTPSNPFQVPSGPSGAPPMPGGPHSYH

SEQ ID NO: 815333 - protein, 300 aa, Homo sapiens; identical to SEQ ID NO: 815332

SEQ ID NO: 815334 - protein, 300 aa, Homo sapiens; identical to SEQ ID NO: 815332

SEQ ID NO: 815335 - protein, 300 aa, Homo sapiens; identical to SEQ ID NO: 815332

SEQ ID NO: 815336 - protein, 314 aa, Homo sapiens
RRFLFRRQEEPRAAGAVAAAALAAVSQAAPASSGPSPSDPSPLLDPTAVSDIAGKMSDEFSLADALPEHSPAKTSAVSNTKPGQPPQGWPGSNPWNNPSAPSSVPSGLPPSATPSTVPFGPAPTGMYPSVPPTGPPPGPPAPFPPSGPSCPPPGGPYPAPTVPGPGPTGPYPTPNMPFPELPRPYGAPTDPAAAGPLGPWGSMSSGPWAPGMGGQYPTPNMPYPSPGPYPAPPPPQAPGAAPPVPWGTVPPGAWGPPAPYPAPTGSYPTPGLYPTPSNPFQVPSGPSGAPPMPGGPHTTQCGVNILVEEPALVI

SEQ ID NO: 815337 - protein, 304 aa, Homo sapiens
RRFLFRRQEEPRAAGAVAAAALAAVSQAAPASSGPSPSDPSPLLDPTAVSDIAGKMSDEFSLADALPEHSPAKTSAVSNTKPGQPPQGWPGSNPWNNPSAPSSVPSGLPPSATPSTVPFGPAPTGMYPSVPPTGPPPGPPAPFPPSGPSCPPPGGPYPAPTVPGPGPTGPYPTPNMPFPELPRPYGAPTDPAAAGPLGPWGSMSSGPWAPGMGGQYPTPNMPYPSPGPYPAPPPPQAPGAAPPVPWGTVPPGAWGPPAPYPAPTGSYPTPGLYPTPSNPFQVPSGPSGAPPMPGGPHVSVQFVI

SEQ ID NO: 815338 - protein, 239 aa, Homo sapiens
RRFLFRRQEEPRAAGAVAAAALAAVSQAAPASSGPSPSDPSPLLDPTAVSDIAGKDYLFCFQLADALPEHSPAKTSAVSNTKPGQPPQGWPGSNPWNNPSAPSSVPSGLPPSATPSTVPFGPAPTGMYPSVPPTGPPPGPPAPFPPSGPSCPPPGGPYPAPTVPGPGPTGPYPPQAPGAAPPVPWGTVPPGAWGPPAPYPAPTGSYPTPGLYPTPSNPFQVPSGPSGAPPMPGGPHSYH

SEQ ID NO: 815339 - protein, 300 aa, Homo sapiens; identical to SEQ ID NO: 815332

SEQ ID NO: 815340 - protein, 304 aa, Homo sapiens; identical to SEQ ID NO: 815337

SEQ ID NO: 815341 - protein, 300 aa, Homo sapiens; identical to SEQ ID NO: 815332

SEQ ID NO: 815342 - protein, 300 aa, Homo sapiens; identical to SEQ ID NO: 815332

SEQ ID NO: 815343 - protein, 293 aa, Homo sapiens
AALPVPAPGGAARCWCCCRRCSSCRQSGCARVFRAQSLGPIAASRPYCGLGYCRLADALPEHSPAKTSAVSNTKPGQPPQGWPGSNPWNNPSAPSSVPSGLPPSATPSTVPFGPAPTGMYPSVPPTGPPPGPPAPFPPSGPSCPPPGGPYPAPTVPGPGPTGPYPTPNMPFPELPRPYGAPTDPAAAGPLGPWGSMSSGPWAPGMGGQYPTPNMPYPSPGPYPAPPPPQAPGAAPPVPWGTVPPGAWGPPAPYPAPTGSYPTPGLYPTPSNPFQVPSGPSGAPPMPGGPHSYH

SEQ ID NO: 815344 - protein, 229 aa, Homo sapiens
MPGKCLMNFRWQMHYLNTPLPLCCEQYSAPSSVPSGLPPSATPSTVPFGPAPTGMYPSVPPTGPPPGPPAPFPPSGPSCPPPGGPYPAPTVPGPGPTGPYPTPNMPFPELPRPYGAPTDPAAAGPLGPWGSMSSGPWAPGMGGQYPTPNMPYPSPGPYPAPPPPQAPGAAPPVPWGTVPPGAWGPPAPYPAPTGSYPTPGLYPTPSNPFQVPSGPSGAPPMPGGPHSYH

SEQ ID NO: 815345 - protein, 300 aa, Homo sapiens; identical to SEQ ID NO: 815332

SEQ ID NO: 815346 - protein, 85 aa, Homo sapiens
GHKQLFQWPHRFHTGEVWSTTLACILHAPLTRVSVITQPSRGIFLSLTSTGQLRCVTTVAVSVNLYWMTASQLTVDGPRHFLPLS

SEQ ID NO: 815347 - protein, 300 aa, Homo sapiens; identical to SEQ ID NO: 815332

SEQ ID NO: 815348 - protein, 109 aa, Homo sapiens [sequence omitted]

SEQ ID NO: 815349 - protein, 202 aa, Homo sapiens
MSGRSVRAETRSRAKDDIKKVMAAIEKVRKWEKKWVTVGDTSLRIFKWVPVTDSKEKEKSKSNSSAAREPNGFPSDASANSSLLLEFQDENSNQSSVSDVYQLKVDSSTNSSPSPQQSESLSPAHTSDFRTDDSQPPTLGQEILEEPSLPSSEVADEPPTLTKEEPVPLETQVVEEEEDSGAPPLKRFCVDQPTVPQTASES

SEQ ID NO: 815350 - protein, 202 aa, Homo sapiens; identical to SEQ ID NO: 815349

SEQ ID NO: 815351 - protein, 238 aa, Homo sapiens
GDSGFRPGLELPGVGARARPSPGPALPSSWAVAPPAFPGFLLIIASSPGVVSARQAERSAYSGVEVGEKKWVTVGDTSLRIFKWVPVTDSKEKEKSKSNSSAAREPNGFPSDASANSSLLLEFQDENSNQSSVSDVYQLKVDSSTNSSPSPQQSESLSPAHTSDFRTDDSQPPTLGQEILEEPSLPSSEVADEPPTLTKEEPVPLETQVVEEEEDSGAPPLKRFCVDQPTVPQTASES

SEQ ID NO: 815352 - protein, 213 aa, Homo sapiens
MTESRSVTQAGVHWRNLGSLQPLPLRFKQFSCLSLLSSWDYREKKWVTVGDTSLRIFKWVPVTDSKEKEKSKSNSSAAREPNGFPSDASANSSLLLEFQDENSNQSSVSDVYQLKVDSSTNSSPSPQQSESLSPAHTSDFRTDDSQPPTLGQEILEEPSLPSSEVADEPPTLTKEEPVPLETQVVEEEEDSGAPPLKRFCVDQPTVPQTASES

SEQ ID NO: 815353 - protein, 205 aa, Homo sapiens
MAGVHWRNLGSLQPLPLRFKQFSCLSLLSSWDYREKKWVTVGDTSLRIFKWVPVTDSKEKEKSKSNSSAAREPNGFPSDASANSSLLLEFQDENSNQSSVSDVYQLKVDSSTNSSPSPQQSESLSPAHTSDFRTDDSQPPTLGQEILEEPSLPSSEVADEPPTLTKEEPVPLETQVVEEEEDSGAPPLKRFCVDQPTVPQTASES

SEQ ID NO: 815354 - protein, 145 aa, Homo sapiens
MSGRSVRAETRSRAKDDIKKVMAAIEKVRKWEKKWVTVGDTSLRIFKWVPVTDSKEKEKSKSNSSAAREPNGFPSDASANSSLLLEFQEPSLPSSEVADEPPTLTKEEPVPLETQVVEEEEDSGAPPLKRFCVDQPTVPQTASES

SEQ ID NO: 815355 - protein, 124 aa, Homo sapiens
GDSGFRPGLELPGVGARARPSPGPALPSSWAVAPPAFPGFLLIIASSPGVVSARQAERSAYSGVEVGEKKWVTVGDTSLRIFKWVPVTDSKETKTATRVPCLTSISLRWTAAPTQAPAPSRVSP

SEQ ID NO: 815356 - protein, 142 aa, Homo sapiens
MPGPWLCPEFLLRKMTTLSCCLCSVWFSDENSNQSSVSDVYQLKVDSSTNSSPSPQQSESLSPAHTSDFRTDDSQPPTLGQEILEEPSLPSSEVADEPPTLTKEEPVPLETQVVEEEEDSGAPPLKRFCVDQPTVPQTASES

SEQ ID NO: 815357 - protein, 192 aa, Homo sapiens
MTESRSVTQAGVHWRNLGSLQPLPLRFKQFSCLSLLSSWDYREKKWVTVGDTSLRIFKWVPVTDSKEKEKSKSNSSAAREPNGFPSDASANSSLLLEFQDSSPSPQQSESLSPAHTSDFRTDDSQPPTLGQEILEEPSLPSSEVADEPPTLTKEEPVPLETQVVEEEEDSGAPPLKRFCVDQPTVPQTASES

SEQ ID NO: 815358 - protein, 202 aa, Homo sapiens; identical to SEQ ID NO: 815349

SEQ ID NO: 815359 - protein, 163 aa, Homo sapiens
MSGRSVRAETRSRAKDDIKKVMAAIEKVRKWEKKWVTVGDTSLRIFKWVPVTDSKEKEKSKSNSSAAREPNGFPSDASANSSLLLEFQDENSNQSSVSDVYQLKVDSSTNSSPSPQQSESLSPAHTSDFRTDDSQPPTLGQEILEEPSLPSSEVADEPPTLTF

SEQ ID NO: 815360 - protein, 163 aa, Homo sapiens; identical to SEQ ID NO: 815359

SEQ ID NO: 815361 - protein, 198 aa, Homo sapiens
MSGRSVRAETRSRAKDDIKKVMAAIEKVRKWEKKWVTVGDTSLRIFKWVPVTDSKEKEKSKSNSSAAREPNGFPSDASANSSLLLEFQDENSNQSSVSDVYQLKVDSSTNSSPSPQQSESLSPAHTSDFRTDDSQPPTLGQEILEEPSLPSSEVADEPPTLCKEPTQAHAGRQPLDAHDLAFVHAAGHQLLARGGTEL

SEQ ID NO: 815362 - protein, 1290 aa, Homo sapiens
MIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPLYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 815363 - protein, 68 aa, Homo sapiens
MSPRCSSHAAARLYDRAPHDAQIRRGCSLEGESVCRGHPRPHGCWGLTGRVRASGRGRAGRDSPALTP

SEQ ID NO: 815364 - protein, 1515 aa, Homo sapiens
GRSGSSARRVSSSSGWSVNRSPSPSSLRPAASSQAERPGAPGARSSGSSAPGRPGSLRPRGGGGGGGNMASAGNAAEPQDRGGGGSGCIGAPGRPAGGGRRRRTGGLRRAAAPDRDYLHRPSYCDAAFALEQISKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPLYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 815365 - protein, 1463 aa, Homo sapiens
GRSGSSARRVSSSSGWSVNRSPSPSSLRPAASSQAERPGAPGARSSGSSAPGRPGSLRPRGGGGGGGNMASAGNAAEPQDRGGGGSGCIGAPGRPAGGGRRRRTGGLRRAAAPDRDYLHRPSYCDAAFALEQISKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPLYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 815366 - protein, 1329 aa, Homo sapiens
MGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPLYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 815367 - protein, 724 aa, Homo sapiens
MRLDSFSLSGKSQWCSLGSDLVPLLFQVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPLYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 815368 - protein, 587 aa, Homo sapiens
GRSGSSARRVSSSSGWSVNRSPSPSSLRPAASSQAERPGAPGARSSGSSAPGRPGSLRPRGGGGGGGNMASAGNAAEPQDRGGGGSGCIGAPGRPAGGGRRRRTGGLRRAAAPDRDYLHRPSYCDAAFALEQISKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRCVCEAYLGREATWRQGRPSCMTRSLLGILQHVGNVQDFLRVLFAFLYRKTDFYRMSPHNW

SEQ ID NO: 815369 - protein, 424 aa, Homo sapiens
GRSGSSARRVSSSSGWSVNRSPSPSSLRPAASSQAERPGAPGARSSGSSAPGRPGSLRPRGGGGGGGNMASAGNAAEPQDRGGGGSGCIGAPGRPAGGGRRRRTGGLRRAAAPDRDYLHRPSYCDAAFALEQISKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVR

SEQ ID NO: 815370 - protein, 135 aa, Homo sapiens
GITQPLPSQLWGEYCLCRVVSLLSTSASSSVLQPQCPKSLRDPAGGGALMSPRCSSHAAARLYDRAPHDAQIRRGCSLEGESVCRGHPRPHGCWGLTGRVRASGRGRAGRDSPALTPPFCFVPRGRLLAGKRRCG

SEQ ID NO: 815371 - protein, 1147 aa, Homo sapiens
MEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKEVKEEAKEQCGDELVAEPADPEEAKSTEDQEENEEDKEEEEKEEDSEEEEDDADSSLESPEENNPLRLSESKKSSPTPKSPHLLLASCRPGGHLGFALVLVG

SEQ ID NO: 815372 - protein, 68 aa, Homo sapiens
ETQIEQSLKTALIMLVDWLSLVPNSARGRPNANMFGLWKPMVFLAIAAVALYVLPNMRQQESEFCLME

SEQ ID NO: 815373 - protein, 120 aa, Homo sapiens
QAAEDSATEHEDDSLELQGLLEDERLASAQQAEVFTKQIQQLQGELRSLREEISLLEHENDGRPWPARGQIPSGHHPQLWAGHTVPEPSPYVPCVPISSASVTQAEKACGERLTSISCLV

SEQ ID NO: 815374 - protein, 1100 aa, Homo sapiens
MEAITSELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKEVKEEAKEQCGDELVAEPADPEEAKSTEDQEENEEDKEEEEKEEDSEEEEDDADSSLESPEENNPLRLSESKKEHVWVVEAYGILGYCSCGSVCVTQHATAGVRVLPHGVMADLGQREGRSPVATTLSFGQDTLCQNPPHMFHVSPSPQPQSPRLKRLVGSG

SEQ ID NO: 815375 - protein, 1286 aa, Homo sapiens
CAPGSGPRARGCGFCSGRRKAAAGAVMEAGAGAGAGAAGWSCPGPGPTVTTLGSYEASEGCERKKGQRWGSLERRGMQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKEVKEEAKEQCGDELVAEPADPEEAKSTEDQEENEEDKEEEEKEEDSEEEEDDADSSLESPEENNPLRLSESKKEHVWVVEAYGILGYCSCGSVCVTQHATAGVRVLPHGVMADLGQREGRSPVATTLSFGQDTLCQNPPHMFHVSPSPQPQSPRLKRLVGSG

SEQ ID NO: 815376 - protein, 1316 aa, Homo sapiens
RRGGLPALRLDGATGGLLLRGSLALARWGVAESGEVRALPFAHPGLDFPPPAPRLPRGHRAGVGRAWGRSQRGLLGPTVTTLGSYEASEGCERKKGQRWGSLERRGMQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKEVKEEAKEQCGDELVAEPADPEEAKSTEDQEENEEDKEEEEKEEDSEEEEDDADSSLESPEENNPLRLSESKKEHVWVVEAYGILGYCSCGSVCVTQHATAGVRVLPHGVMADLGQREGRSPVATTLSFGQDTLCQNPPHMFHVSPSPQPQSPRLKRLVGSG

SEQ ID NO: 815377 - protein, 900 aa, Homo sapiens
MEAITSELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEEHVWVVEAYGILGYCSCGSVCVTQHATAGVRVLPHGVMADLGQREGRSPVATTLSFGQDTLCQNPPHMFHVSPSPQPQSPRLKRLVGSG

SEQ ID NO: 815378 - protein, 995 aa, Homo sapiens
MEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEEHVWVVEAYGILGYCSCGSVCVTQHATAGVRVLPHGVMADLGQREGRSPVATTLSFGQDTLCQNPPHMFHVSPSPQPQSPRLKRLVGSG

SEQ ID NO: 815379 - protein, 715 aa, Homo sapiens
MQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEEHVWVVEAYGILGYCSCGSVCVTQHATAGVRVLPHGVMADLGQREGRSPVATTLSFGQDTLCQNPPHMFHVSPSPQPQSPRLKRLVGSG

SEQ ID NO: 815380 - protein, 987 aa, Homo sapiens
MEAITSELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKKIRRKMKRTKRKRRRKKTVKRRRMTPTLPLKVPKKITPSDFPRAKRNMFGLWKPMVFLAIAAVALYVLPNMRQQESEFCLME

SEQ ID NO: 815381 - protein, 401 aa, Homo sapiens
MEAITSELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKSSPTPKSPHLLLASCRPGGHLGFALVLVG

SEQ ID NO: 815382 - protein, 282 aa, Homo sapiens
MEAITSELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQSSPTPKSPHLLLASCRPGGHLGFALVLVG

SEQ ID NO: 815383 - protein, 1017 aa, Homo sapiens
MEAITSELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKEVKEEAKEQCGDELVAEPADPEEAKSTEDQEENEEDKEEEEKEEDSEEEEDDADSSLESPEENNPLRLSESKKVTRAKA

SEQ ID NO: 815384 - protein, 1023 aa, Homo sapiens
MEAITSELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKEVKEEAKEQCGDELVAEPADPEEAKSTEDQEENEEDKEEEEKEEDMATTLSFGQDTLCQNPPHMFHVSPSPQPQSPRLKRLVGSG

SEQ ID NO: 815385 - protein, 1040 aa, Homo sapiens
MEAITSELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKEVKEEAKEQCGDELVAEPADPEEAKSTEDQEENEEDKEEEEKEEDSEEEEDDADSSLESPEENNPLRLSESKKSSPTPKSPHLLLASCRPGGHLGFALVLVG

SEQ ID NO: 815386 - protein, 856 aa, Homo sapiens
MEAITSELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELVAEPADPEEAKSTEDQEENEEDKEEEEKEEDMATTLSFGQDTLCQNPPHMFHVSPSPQPQSPRLKRLVGSG

SEQ ID NO: 815387 - protein, 501 aa, Homo sapiens
MEAITSELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKVIVVQRGDSSWALAPERRGTEAKSEGTQPKGLMAFLGRKQRQGHMLLTSKLFALTLTLSQSHSLVGSIPLDPSLNP

SEQ ID NO: 815388 - protein, 102 aa, Homo sapiens
MPSTYAQGIGSQSQSTGPHPCTLTCWKSCFLELVQHCHEIRSFTGNAAAILPYSHPTESGGSAVLQGQPEEIRWTSKRGGKERGDGGGKKGSERGSKGAVWG

SEQ ID NO: 815389 - protein, 180 aa, Homo sapiens
MKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 815390 - protein, 180 aa, Homo sapiens; identical to SEQ ID NO: 815389

SEQ ID NO: 815391 - protein, 223 aa, Homo sapiens
DAWADALWSAHASAKQSTSKVPKEGLLSLHLLCSTAHYQKTAEMKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 815392 - protein, 180 aa, Homo sapiens; identical to SEQ ID NO: 815389

SEQ ID NO: 815393 - protein, 219 aa, Homo sapiens
LFRPSVRGRLGQSTSKVPKEGLLSLHLLCSTAHYQKTAEMKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 815394 - protein, 180 aa, Homo sapiens; identical to SEQ ID NO: 815389

SEQ ID NO: 815395 - protein, 180 aa, Homo sapiens; identical to SEQ ID NO: 815389

SEQ ID NO: 815396 - protein, 219 aa, Homo sapiens; identical to SEQ ID NO: 815393

SEQ ID NO: 815397 - protein, 200 aa, Homo sapiens
HAHTTSLPIPTHQHRLVTAEMKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 815398 - protein, 142 aa, Homo sapiens
KKNRANGDRALFRPTRPGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 815399 - protein, 180 aa, Homo sapiens; identical to SEQ ID NO: 815389

SEQ ID NO: 815400 - protein, 180 aa, Homo sapiens; identical to SEQ ID NO: 815389

SEQ ID NO: 815401 - protein, 93 aa, Homo sapiens
EEKKPGEWGPGPFSTHASDVSSYLEGQAAKEFIAWLVKGRGRRDFPEEVAIVEELGRRHADGSFSDEMNTILDNLAARDFINWLIQTKITDRK

SEQ ID NO: 815402 - protein, 129 aa, Homo sapiens
MKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSVSQKRSPLLKNLAADMLMVLSLMR

SEQ ID NO: 815403 - protein, 260 aa, Homo sapiens
KSFVTKTHYLQMRNLYCQRNICEAKQSWRVYKSSAPWCRSTELRTQTEHIKSSQRGLALSSPALFYSTLPEDSRNEKHLLCGWIICNAGTRQLATFPSRHRGEIQIILSFPGSKRPTIWIDTGIHSREWVTQASGVLVAKKITQDYGQDAAFTAILDTLDIFLEIVTNPDGFAFTHSTNRMWRKTRSHTAGSLCGVDPNRNWDAGFGLSGASSNPCSETYHGKFANSEVEVKSIVDFVKDLGNIKGFISSTVIPGPHVSY

SEQ ID NO: 815404 - protein, 108 aa, Homo sapiens
KSFVTKTHYLQMRNLYCQRNICEAKQSWRVYKSSAPWCRSTELRTQTEHIKSSQRGLALSSPALFYSTLPEDSRNEKHLLCGWIICNAGTRQLATFPSRAPGENSVFF

SEQ ID NO: 815405 - protein, 967 aa, Homo sapiens
MGPGQPASTCVHLAPRTQLDGRSDPKVLQTQNQLQFNRNVPTHSSNLAIRYSCPHAIRIEKLKHSYNESYHCKDADCRVGPDLGSSVSFSVISQERLSYAVHLARRDVKRRQFEKHIKEHHLRSQPQSSQKCGHTKYKIPDHRVERKESKSQAACQCSHQPSKVEISSSGAKVYLYSSHPGQSDLTVPNSPPTHDPGLQPHPRIGDHKNISEQKSLLEVQRLQKELSSCIHKIEEVTKKDRLEEALDPDEERRIRIRRQEQAARSARMLYVLQQQVKEIQEELDKLSPHKIKHTKKSWAMSKLAAAHRGAIRALQMFVTQFTDRGEHPLPARCKELGSLIRQLSLCSVKLDADPSVPDVVIDILQQIEALESLLEKKLSPKKVKKCFSEIRSRFPIGSQKALERWPSTSPKGERRPLTAKDTFPQETSRPSVAKQLLADKYQPDTELPETQRLQSELDVLDADIVLEEGPFILDQSASFKDEVLAVAKTKAGKKKPVTENVPFRKKDTLAPARQQGLRKAERGRQSQPHSKSRVQQTTVSSRLKMNRQPVKDRKAPWIPPNPTSPPASPKCAAWLKVKTSPRDATKEPLQQEDPQEESHLTGAVEHEAARLAWLDAETSKRLKELEELKAKEIDSMQKQRLDWLDAETSRRTKELNELKAEEMYRLQQLSVSATHLADKVEEAVLDRLKPLLVKAQRVNSTTEANIHLKDGSSVNTAKAQPAQEVAAVDFESNNIRQLDDFLEDCASELWAVTHAKILGSETLATVEDSKDSPDLEIMMRRMEEMEKYQESVRQRYNKIAYADPRLWMQEENNDQKISAISEKPLSPHPIRITKTVDRKDPAVNIMLERPCNGNSLDESVGTEEGSEKREAPLLSLAEDSQQKEGRAPLFVPPGMQHSIGDYCSRFEQYLRIISHEAVGSFNPWLIAESFSEELVDEALGAVAAELQDMCEDYAEAVFTSEFLEAAT

SEQ ID NO: 815406 - protein, 689 aa, Homo sapiens [sequence omitted]

SEQ ID NO: 815407 - protein, 672 aa, Homo sapiens
MLASSEYGNNFSHLVYYQSWAMSKLAAAHRGAIRALQMFVTQFTDRGEHPLPARCKELGSLIRQLSLCSVKLDADPSVPDVVIDILQQIEALESLLEKKLSPKKVKKCFSEIRSRFPIGSQKALERWPSTSPKGERRPLTAKDTFPQETSRPSVAKQLLADKYQPDTELPETQRLQSELDVLDADIVLEEGPFILDQSASFKDEVLAVAKTKAGKKKPVTENVPFRKKDTLAPARQQGLRKAERGRQSQPHSKSRVQQTTVSSRLKMNRQPVKDRKAPWIPPNPTSPPASPKCAAWLKVKTSPRDATKEPLQQEDPQEESHLTGAVEHEAARLAWLDAETSKRLKELEELKAKEIDSMQKQRLDWLDAETSRRTKELNELKAEEMYRLQQLSVSATHLADKVEEAVLDRLKPLLVKAQRVNSTTEANIHLKDGSSVNTAKAQPAQEVAAVDFESNNIRQLDDFLEDCASELWAVTHAKILGSETLATVEDSKDSPDLEIMMRRMEEMEKYQESVRQRYNKIAYADPRLWMQEENNESRRQWIARIQPVNIMLERPCNGNSLDESVGTEEGSEKREAPLLSLAEDSQQKEGRAPLFVPPGMQHSIGDYCSRFEQYLRIISHEAVGSFNPWLIAESFSEELVDEALGAVAAELQDMCEDYAEAVFTSEFLEAAT

SEQ ID NO: 815408 - protein, 689 aa, Homo sapiens [sequence omitted]

SEQ ID NO: 815409 - protein, 402 aa, Homo sapiens
GLNDGRSMAWRHLQKRAQDAVIILGGGGLLFASYLMATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVINRYGFNSHGLSVVEHRLRARQQKQAKLTEDGLPLGVNLGKNKTSVDAAEDYAEGVRVLGPLADYLVVNVSSPNTAGLRSLQGKAELRRLLTKVLQERDGLRRVHRPAVLVKIAPDLTSQDKEDIASVVKELGIDGLIVTNTTVSRPAGLQGALRSETGGLSGKPLRDLSTQTIREMYALTQGRVPIIGVGGVSSGQDALEKIRAGASLVQLYTALTFWGPPVVGKVKRELEALLKEQGFGGVTDAIGADHRR

SEQ ID NO: 815410 - protein, 402 aa, Homo sapiens; identical to SEQ ID NO: 815409

SEQ ID NO: 815411 - protein, 367 aa, Homo sapiens
MATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVINRYGFNSHGLSVVEHRLRARQQKQAKLTEDGLPLGVNLGKNKTSVDAAEDYAEGVRVLGPLADYLVVNVSSPNTAGLRSLQGKAELRRLLTKVLQERDGLRRVHRPAVLVKIAPDLTSQDKEDIASVVKELGIDGLIVTNTTVSRPAGLQGALRSETGGLSGKPLRDLSTQTIREMYALTQGRVPIIGVGGVSSGQDALEKIRAGASLVQLYTALTFWGPPVVGKVKRELEALLKEQGFGGVTDAIGADHRR

SEQ ID NO: 815412 - protein, 449 aa, Homo sapiens
PGTGEGENGESGRARHGPKAAPGVWAPLGRVRVSGVSCKCSCVCICTWTRSGVCRQRLQVWKRAQDAVIILGGGGLLFASYLMATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVINRYGFNSHGLSVVEHRLRARQQKQAKLTEDGLPLGVNLGKNKTSVDAAEDYAEGVRVLGPLADYLVVNVSSPNTAGLRSLQGKAELRRLLTKVLQERDGLRRVHRPAVLVKIAPDLTSQDKEDIASVVKELGIDGLIVTNTTVSRPAGLQGALRSETGGLSGKPLRDLSTQTIREMYALTQGRVPIIGVGGVSSGQDALEKIRAGASLVQLYTALTFWGPPVVGKVKRELEALLKEQGFGGVTDAIGADHRR

SEQ ID NO: 815413 - protein, 483 aa, Homo sapiens
PGTGEGENGESGRARHGPKAAPGVWAPLGRVRVSGVSCKCSCVCICTWTRSGVCRQRLQVWKRAQDAVIILGGGGLLFASYLMATGDERFYAEHLMPTLQGLLDPESAHRLAVRFTSLGLLPRARFQDSDMLVVLPDTLYIKYKGEGCSPLNFSAGTDLFENQNPKEVRVLGHKFRNPVGIAAGFDKHGEAVDGLYKMGFGFVEIGSVTPKPQEGNPRPRVFRLPEDQAVINRYGFNSHGLSVVEHRLRARQQKQAKLTEDGLPLGVNLGKNKTSVDAAEDYAEGVRVLGPLADYLVVNVSSPNTAGLRSLQGKAELRRLLTKVLQERDGLRRVHRPAVLVKIAPDLTSQDKEDIASVVKELGIDGLIVTNTTVSRPAGLQGALRSETGGLSGKPLRDLSTQTIREMYALTQGRVPIIGVGGVSSGQDALEKIRAGASLVQLYTALTFWGPPVVGKVKRELEALLKEQGFGGVTDAIGADHRR

SEQ ID NO: 815414 - protein, 460 aa, Homo sapiens
GLNDGRSMAWRHLQKRAQDAVIILGGGGLLFASYLMATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVINRWGSISSELARQNNLLNIQLLQITAGAGMMVLGESYEVSRGVRSCSEPCVCGSWLCGMWYGFNSHGLSVVEHRLRARQQKQAKLTEDGLPLGVNLGKNKTSVDAAEDYAEGVRVLGPLADYLVVNVSSPNTAGLRSLQGKAELRRLLTKVLQERDGLRRVHRPAVLVKIAPDLTSQDKEDIASVVKELGIDGLIVTNTTVSRPAGLQGALRSETGGLSGKPLRDLSTQTIREMYALTQGRVPIIGVGGVSSGQDALEKIRAGASLVQLYTALTFWGPPVVGKVKRELEALLKEQGFGGVTDAIGADHRR

SEQ ID NO: 815415 - protein, 295 aa, Homo sapiens
GLNDGRSMAWRHLQKRAQDAVIILGGGGLLFASYLMATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVINRYGFNSHGLSVVEHRLRARQQKQAKLTEDGLPLGVNLGKNKTSVDAAEDYAEGVRVLGPLADYLVVNVSSPNTAGLRSLQGKAELRRLLTKVLQERDGLRRVHRPAVLVKIAPDLTSQDKEDIASVVKELGIDGLIVTHTHTQF

SEQ ID NO: 815416 - protein, 354 aa, Homo sapiens
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKILGYDRCDAGWLADGSVRYPISRPRRRCSPTEAAVRFVGFPDKKHKLYGVYCFRAYN

SEQ ID NO: 815417 - protein, 354 aa, Homo sapiens; identical to SEQ ID NO: 815416

SEQ ID NO: 815418 - protein, 107 aa, Homo sapiens
FKYPHNTLITCLFNVIGHVIKVLLGRKVNWHDFAFFDPVMYESLRQLILASQSSDADAVFSAMDLAFAIDLCKEEGGGQVELIPNGVNIPVTPQNVYEYVRIFEWGI

SEQ ID NO: 815419 - protein, 2810 aa, Homo sapiens
RPRVEDEKESTMTSIHFVVHPLPGTEDQLNDRLREVSEKLNKYNLNSHPPLNVLEQATIKQCVVGPNHAAFLLEDGRVCRIGFSVQPDRLELGKPDNNDGSKLNSNSGAGRTSRPGRTSDSPWFLSGSETLGRLAGNTLGSRWSSGVGGSGGGSSGRSSAGARDSRRQTRVIRTGRDRGSGLLGSQPQPVIPASVIPEELISQAQVVLQGKSRSVIIRELQRTNLDVNLAVNNLLSRDDEDGDDGDDTASESYLPGEDLMSLLDADIHSAHPSVIIDADAMFSEDISYFGYPSFRRSSLSRLGSSRVLLLPLERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 815420 - protein, 2810 aa, Homo sapiens; identical to SEQ ID NO: 815419

SEQ ID NO: 815421 - protein, 2810 aa, Homo sapiens; identical to SEQ ID NO: 815419

SEQ ID NO: 815422 - protein, 2810 aa, Homo sapiens; identical to SEQ ID NO: 815419

SEQ ID NO: 815423 - protein, 2810 aa, Homo sapiens; identical to SEQ ID NO: 815419

SEQ ID NO: 815424 - protein, 2810 aa, Homo sapiens; identical to SEQ ID NO: 815419

SEQ ID NO: 815425 - protein, 2551 aa, Homo sapiens
MSLLDADIHSAHPSVIIDADAMFSEDISYFGYPSFRRSSLSRLGSSRVLLLPLERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 815426 - protein, 2849 aa, Homo sapiens
AFLLEDGRVCRIGFSVQPDRLELGKPDNNDGSKLDSNSGAGRTSRPARTNDSPWFLSDSETLDRLAGNTLGLREVSEKLNKYNLNSHPPLNVLEQATIKQCVVGPNHAAFLLEDGRVCRIGFSVQPDRLELGKPDNNDGSKLNSNSGAGRTSRPGRTSDSPWFLSGSETLGRLAGNTLGSRWSSGVGGSGGGSSGRSSAGARDSRRQTRVIRTGRDRGSGLLGSQPQPVIPASVIPEELISQAQVVLQGKSRSVIIRELQRTNLDVNLAVNNLLSRDDEDGDDGDDTASESYLPGEDLMSLLDADIHSAHPSVIIDADAMFSEDISYFGYPSFRRSSLSRLGSSRVLLLPLERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 815427 - protein, 1880 aa, Homo sapiens
MSLLDADIHSAHPSVIIDADAMFSEDISYFGYPSFRRSSLSRLGSSRVLLLPLERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQGHLLMILLHN

SEQ ID NO: 815428 - protein, 1188 aa, Homo sapiens
MELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 815429 - protein, 2536 aa, Homo sapiens
MSLLDADIHSAHPSVIIDADAMFSEDISYFGYPSFRRSSLSRLGSSRVLLLPLERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQQENRKRHGSSRSVVDMDLDDTDDGDDNAPLFYQPGKRGFYTPRPGKNTEARLNCFRNIGRILGLCLLQNELCPITLNRHVIKVLLGRKSLRQLILASQSSDADAVFSAMDLAFAIDLCKEEGGGQVELIPNGVNIPVTPQNVYEYVRKYAEHRMLVVAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 815430 - protein, 381 aa, Homo sapiens [sequence omitted]

SEQ ID NO: 815431 - protein, 169 aa, Homo sapiens
LGFYYFVRQRALCGYTLNSAIMAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 815432 - protein, 215 aa, Homo sapiens
EECELVTRLASETQILEGSLGISVKSHCSTGDAHTVLSESNRNDEHCGNSNNKCEVIPESTSAEQPLHAMRKGLLDVLPKNSLEDLTAEDFRLLVNGCGEVNVQMLISFTSFNDESGENAEKLLQFKRWFWSIVEKMSMTERQDLVYFWTSSPSLPASEEGFQPMPSITIRPPDDQHLPTANTCISRLYVPLYSSKQILKQKLLLAIKTKNFGFV

SEQ ID NO: 815433 - protein, 2412 aa, Homo sapiens
MSLLDADIHSAHPSVIIDADAMFSEDISYFGYPSFRRSSLSRLGSSRVLLLPLERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDRDFRRQLSIDTRPFRPASEGNPSDDPEPLPAHRQALGERLYPRVQAMQPAFASKITGMLLELSPAQLLLLLASEDSLRARVDEAMELIIAHGRENGADSILDLGLVDSSEKVQQENRKRHGSSRSVVDMDLDDTDDGDDNAPLFYQPGKRGFYTPRPGKNTEARLNCFRNIGRILGLCLLQNELCPITLNRHVIKVLLGRKVNWHDFAFFDPVMYESLRQLILASQSSDADAVFSAMDLAFAIDLCKEEGGGQVELIPNGVNIPVTPQNVYEYVRKYAEHRMLVVAEQPLHVSVSRKCC

SEQ ID NO: 815434 - protein, 2114 aa, Homo sapiens
MSLLDADIHSAHPSVIIDADAMFSEDISYFGYPSFRRSSLSRLGSSRVLLLPLERDSELLRERESVLRLRERRWLDGASFDNERGSTSKEGEPNLDKKNTPVQSPVSLGEDLQWWPDKDGTKFICIGALYSELLAVSSKGELYQWKWSESEPYRNAQNPSLHHPRATFLGLTNEKIVLLSANSIRATVATENNKVATWVDETLSSVASKLEHTAQTYSELQGERIVSLHCCALYTCAQLENSLYWWGVVPFSQRKKMLEKARAKNKKPKSSAGISSMPNITVGTQVCLRNNPLYHAGAVAFSISAGIPKVGVLMESVWNMNDSCRFQLRSPESLKNMEKASKTTEAKPESKQEPVKTEMGPPPSPASTCSDASSIASSASMPYKRRRSTPAPKEEEKVNEEQWSLREVVFVEDVKNVPVGKVLKVDGAYVAVKFPGTSSNTNCQNSSGPDADPSSLLQDCRLLRIDELQVVKTGGTPKVPDCFQRTPKKLCIPEKTEILAVNVDSKGVHAVLKTGNWVRYCIFDLATGKAEQENNFPTSSIAFLGQNERNVAIFTAGQESPIILRDGNGTIYPMAKDCMGGIRDPDWLDLPPISSLGMGVHSLINLPANSTIKKKAAVIIMAVEKQTLMQHILRCDYEACRQYLMNLEQAVVLEQNLQMLQTFISHRCDGNRNILHACVSVCFPTSNKETKEEEEAERSERNTFAERLSAVEAIANAISVVSSNGPGNRAGSSSSRSLRLREMMRRSLRAAGLGRHEAGASSSDHQDPVSPPIAPPSWVPDPPAMDPDGDIDFILAPAVGSLTTAATGTGQGPSTSTIPGPSTEPSVVESKDRKANAHFILKLLCDSVVLQPYLRELLSAKDARGMTPFMSAVSGRAYPAAITILETAQKIAKAEISSSEKEEDVFMGMVCPSGTNPDDSPLYVLCCNDTCSFTWTGAEHINQDIFECRTCGLLESLCCCTECARVCHKGHDCKLKRTSPTAYCDCWEKCKCKTLIAGQKSARLDLLYRLLTATNLVTLPNSRGEHLLLFLVQTVARQTVEHCQYRPPRIREDRNRKTASPEDSDMPDHDLEPPRFAQLALERVLQDWNALKSMIMFGSQENKDPLSASSRIGHLLPEEQVYLNQQSGTIRLDCFTHCLIVKCTADILLLDTLLGTLVKELQNKYTPGRREEAIAVTMRFLRSVARVFVILSVEMASSKKKNNFIPQPIGKCKRVFQALLPYAVEELCNVAESLIVPVRMGIARPTAPFTLASTSIDAMQGSEELFSVEPLPPRPSSDQSSSSSQSQSSYIIRNPQQRRISQSQPVRGRDEEQDDIVSADVEEVEVVEGVAGEEDHHDEQEEHGEENAEAEGQHDEHDEDGSDMELDLLAAAETESDSESNHSNQDNASGRRSVVTAATAGSEAGASSVPAFFSEDDSQSNDSSDSDSSSSQSDDIEQETFMLDEPLERTTNSSHANGAAQAPRSMQWAVRNTQHQRAASTAPSSTSTPAASSAGLIYIDPSNLRRSGTISTSAAAAAAALEASNASSYLTSASSLARAYSIVIRQISDLMGLIPKYNHLVYSQIPAAVKLTYQDAVNLQNYVEEKLIPTWNWMVSIMDSTEAQLRYGSALASAGDPGHPNHPLHASQNSARRERMTAREEASLRTLEGRRRATLLSARQGMMSARGDFLNYALSLMRSHNDEHSDVLPVLDVCSLKHVAYVFQALIYWIKAMNQQTTLDTPQLERKRTRELLELGIDNEDSEHENDDDTNQSATLNDKDDDSLPAETGQNHPFFRRSDSMTFLGCIPPNPFEVPLAEAIPLADQPHLLQPNARKEDLFGRPSQGLYSSSASSGKCLMEVTVDRNCLEVLPTKMSYAANLKNVMNMQNRQKKEGEEQPVLPEETESSKPGPSAHDLAAQLKSSLLAEIGLTESEGPPLTSFRPQCSFMGMVISHDMLLGRWRLSLELFGRVFMEDVGAEPGSILTELGGFEVKESKFRREMEKLRNQQSRDLSLEVDRDRDLLIQQTMRQLNNHFGRRCATTPMAVHRVKVTFKDEPGEGSGVARSFYTAIAQAFLSNEKLPNLECIQNANKGTHTSLMQRLRNRGERDREREREREMRRSSGLRAGSRRDRDR

SEQ ID NO: 815435 - protein, 73 aa, Homo sapiens
NSPIFRSRWSSGVGGSGGGSSGRSSAGARDSRRQTRVIRTGRDRGSGLLGSQPQPVIPASVIPEELISQVWIS

SEQ ID NO: 815436 - protein, 604 aa, Homo sapiens
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKGKKQLPDSNEIVEKLLLRRKFIPDPQGSNMMFAFFAQHFTHQFFKTDHKRGPAFTNGLGHGVDLNHIYGETLARQRKLRLFKDGKMKYQIIDGEMYPPTVKDTQAEMIYPPQVPEHLRFAVGQEVFGLVPGLMMYATIWLREHNRVCDVLKQEHPEWGDEQLFQTSRLILIGETIKIVIEDYVQHLSGYHFKLKFDPELLFNKQFQYQNRIAAEFNTLYHWHPLLPDTFQIHDQKYNYQQFIYNNSILLEHGITQFVESFTRQIAGRVAGGRNVPPAVQKVSQASIDQSRQMKYQSFNEYRKRFMLKPYESFEELTGEKEMSAELEALYGDIDAVELYPALLVEKPRPDAIFGETMVEVGAPFSLKGLMGNVICSPAYWKPSTFGGEVGFQIINTASIQSLICNNVKGCPFTSFSVPDPELIKTVTINASSSRSGLDDINPTVLLKERSTEL

SEQ ID NO: 815437 - protein, 604 aa, Homo sapiens; identical to SEQ ID NO: 815436

SEQ ID NO: 815438 - protein, 110 aa, Homo sapiens
STYRSRPRRYVEPPEMIGPMRPEQFSDEVEPATPEEGEPATQRQDPAAAQEGEDEGASAGQGPKPEAHSQEQGHPQTGCECEDGPDGQEMDPPNPEEVKTPEEGEKQSQC

SEQ ID NO: 815439 - protein, 91 aa, Homo sapiens
NETYFLFAHPHVFPSPSSSVMKWNQQHLKKGNQQLNVRILQLLRRERMREHLQVKGRSLKLIARNRVTHRLGVSVKMVLMGRRWTRQIQRR

SEQ ID NO: 815440 - protein, 754 aa, Homo sapiens [sequence omitted]

SEQ ID NO: 815441 - protein, 881 aa, Homo sapiens
MFWKFDLHTSSHLDTLLEREDLSLPELLDEEDVLQECKVVNRKLLDFLLQPPHLQAMVAWVTQEPPDSGEERLRYKYPSVACEILTSDVPQINDALGADESLLNRLYGFLQSTGSLNPLLASFFSKVMGILINRKTDQLVSFLRKKDDFVDLLLQHIGTSAIMDLLLRLLTCVERPQLRQDVVNWLNEEKIVQRLIEQIHPSKDENQHSNASQSLCDIIRLSREQMIQVQDSPEPDQLLATLEKQETIEQLLSNMFEGEQSQSVIVSGIQVLLTLLEPRRPRSESVTVNSFFSSVDGQLELLAQGALESTVSSVGALHALRPRLSCFHQLLLEPPKLEPLQMTWGMLAPPLGNTRLHVVKLLASALSANDAALTHELLALDVPNTMLDLFFHYVFNNFLHAQVEGCVSTMLSLGPPPDSSPETPIQNPVVKHLLQQCRLVERILTSWEENDRVQCAGGPRKGYMGHLTRVAGALVQNTEKGPNAEQLRQLLKELPSEQQEQWEAFVSGPLAETNKKNMVDLVNTHHLHSSSDDEDDRLKEFNFPEEAVLQQAFMDFQMQRMTSAFIDHFGFNDEEFGEQEESVNAPFDKTANITFSLNADDENPNANLLEICYKDRIQQFDDDEEEEDEEEAQGSGESDGEDGAWQGSQLARGARLGQPPGVRSGGSTDSEDEEEEDEEEEEDEEGIGCAARGGATPLSYPSPGPQPPGPSWTATFDPVPTDAPTSPRVSGEEELHTGPPAPQGPLSVPQGLPTQSLASPPARDALQLRSQDPTPPSAPQEATEGSKVTEPSAPCQALVSIGDLQATFHGIRSAPSSSDSATRDPSTSVPASGAHQPPQTTEGEKSPEPLGLPQSQSAQALTPPPIPNGSAPEGPASPGSQ

SEQ ID NO: 815442 - protein, 892 aa, Homo sapiens
MMCGAHMVSFGTRYMEALHTSSHLDTLLEREDLSLPELLDEEDVLQECKVVNRKLLDFLLQPPHLQAMVAWVTQEPPDSGEERLRYKYPSVACEILTSDVPQINDALGADESLLNRLYGFLQSTGSLNPLLASFFSKVMGILINRKTDQLVSFLRKKDDFVDLLLQHIGTSAIMDLLLRLLTCVERPQLRQDVVNWLNEEKIVQRLIEQIHPSKDENQHSNASQSLCDIIRLSREQMIQVQDSPEPDQLLATLEKQETIEQLLSNMFEGEQSQSVIVSGIQVLLTLLEPRRPRSESVTVNSFFSSVDGQLELLAQGALESTVSSVGALHALRPRLSCFHQLLLEPPKLEPLQMTWGMLAPPLGNTRLHVVKLLASALSANDAALTHELLALDVPNTMLDLFFHYVFNNFLHAQVEGCVSTMLSLGPPPDSSPETPIQNPVVKHLLQQCRLVERILTSWEENDRVQCAGGPRKGYMGHLTRVAGALVQNTEKGPNAEQLRQLLKELPSEQQEQWEAFVSGPLAETNKKNMVDLVNTHHLHSSSDDEDDRLKEFNFPEEAVLQQAFMDFQMQRMTSAFIDHFGFNDEEFGEQEESVNAPFDKTANITFSLNADDENPNANLLEICYKDRIQQFDDDEEEEDEEEAQGSGESDGEDGAWQGSQLARGARLGQPPGVRSGGSTDSEDEEEEDEEEEEDEEGIGCAARGGATPLSYPSPGPQPPGPSWTATFDPVPTDAPTSPRVSGEEELHTGPPAPQGPLSVPQGLPTQSLASPPARDALQLRSQDPTPPSAPQEATEGSKVTEPSAPCQALVSIGDLQATFHGIRSAPSSSDSATRDPSTSVPASGAHQPPQTTEGEKSPEPLGLPQSQSAQALTPPPIPNGSAPEGPASPGSQ

SEQ ID NO: 815443 - protein, 757 aa, Homo sapiens
LGQALCMTQPVCPQLVSFLRKKDDFVDLLLQHIGTSAIMDLLLRLLTCVERPQLRQDVVNWLNEEKIVQRLIEQIHPSKDENQHSNASQSLCDIIRLSREQMIQVQDSPEPDQLLATLEKQETIEQLLSNMFEGEQSQSVIVSGIQVLLTLLEPRRPRSESVTVNSFFSSVDGQLELLAQGALESTVSSVGALHALRPRLSCFHQLLLEPPKLEPLQMTWGMLAPPLGNTRLHVVKLLASALSANDAALTHELLALDVPNTMLDLFFHYVFNNFLHAQVEGCVSTMLSLGPPPDSSPETPIQNPVVKHLLQQCRLVERILTSWEENDRVQCAGGPRKGYMGHLTRVAGALVQNTEKGPNAEQLRQLLKELPSEQQEQWEAFVSGPLAETNKKNMVDLVNTHHLHSSSDDEDDRLKEFNFPEEAVLQQAFMDFQMQRMTSAFIDHFGFNDEEFGEQEESVNAPFDKTANITFSLNADDENPNANLLEICYKDRIQQFDDDEEEEDEEEAQGSGESDGEDGAWQGSQLARGARLGQPPGVRSGGSTDSEDEEEEDEEEEEDEEGIGCAARGGATPLSYPSPGPQPPGPSWTATFDPVPTDAPTSPRVSGEEELHTGPPAPQGPLSVPQGLPTQSLASPPARDALQLRSQDPTPPSAPQEATEGSKVTEPSAPCQALVSIGDLQATFHGIRSAPSSSDSATRDPSTSVPASGAHQPPQTTEGEKSPEPLGLPQSQSAQALTPPPIPNGSAPEGPASPGSQ

SEQ ID NO: 815444 - protein, 718 aa, Homo sapiens
NTCPCVWVTIFPWMVSSWEGLPAPGCRGPGGPTRILTCLSPFQQHSNASQSLCDIIRLSREQMIQVQDSPEPDQLLATLEKQETIEQLLSNMFEGEQSQSVIVSGIQVLLTLLEPRRPRSESVTVNSFFSSVDGQLELLAQGALESTVSSVGALHALRPRLSCFHQLLLEPPKLEPLQMTWGMLAPPLGNTRLHVVKLLASALSANDAALTHELLALDVPNTMLDLFFHYVFNNFLHAQVEGCVSTMLSLGPPPDSSPETPIQNPVVKHLLQQCRLVERILTSWEENDRVQCAGGPRKGYMGHLTRVAGALVQNTEKGPNAEQLRQLLKELPSEQQEQWEAFVSGPLAETNKKNMVDLVNTHHLHSSSDDEDDRLKEFNFPEEAVLQQAFMDFQMQRMTSAFIDHFGFNDEEFGEQEESVNAPFDKTANITFSLNADDENPNANLLEICYKDRIQQFDDDEEEEDEEEAQGSGESDGEDGAWQGSQLARGARLGQPPGVRSGGSTDSEDEEEEDEEEEEDEEGIGCAARGGATPLSYPSPGPQPPGPSWTATFDPVPTDAPTSPRVSGEEELHTGPPAPQGPLSVPQGLPTQSLASPPARDALQLRSQDPTPPSAPQEATEGSKVTEPSAPCQALVSIGDLQATFHGIRSAPSSSDSATRDPSTSVPASGAHQPPQTTEGEKSPEPLGLPQSQSAQALTPPPIPNGSAPEGPASPGSQ

SEQ ID NO: 815445 - protein, 881 aa, Homo sapiens; identical to SEQ ID NO: 815441

SEQ ID NO: 815446 - protein, 881 aa, Homo sapiens; identical to SEQ ID NO: 815441

SEQ ID NO: 815447 - protein, 881 aa, Homo sapiens; identical to SEQ ID NO: 815441

SEQ ID NO: 815448 - protein, 881 aa, Homo sapiens; identical to SEQ ID NO: 815441

SEQ ID NO: 815449 - protein, 881 aa, Homo sapiens; identical to SEQ ID NO: 815441

SEQ ID NO: 815450 - protein, 881 aa, Homo sapiens; identical to SEQ ID NO: 815441

SEQ ID NO: 815451 - protein, 881 aa, Homo sapiens; identical to SEQ ID NO: 815441

SEQ ID NO: 815452 - protein, 502 aa, Homo sapiens
VAVIPVLDLFFHICLGLGKIAARVEGCVSTMLSLGPPPDSSPETPIQNPVVKHLLQQCRLVERILTSWEENDRVQCAGGPRKGYMGHLTRVAGALVQNTEKGPNAEQLRQLLKELPSEQQEQWEAFVSGPLAETNKKNMVDLVNTHHLHSSSDDEDDRLKEFNFPEEAVLQQAFMDFQMQRMTSAFIDHFGFNDEEFGEQEESVNAPFDKTANITFSLNADDENPNANLLEICYKDRIQQFDDDEEEEDEEEAQGSGESDGEDGAWQGSQLARGARLGQPPGVRSGGSTDSEDEEEEDEEEEEDEEGIGCAARGGATPLSYPSPGPQPPGPSWTATFDPVPTDAPTSPRVSGEEELHTGPPAPQGPLSVPQGLPTQSLASPPARDALQLRSQDPTPPSAPQEATEGSKVTEPSAPCQALVSIGDLQATFHGIRSAPSSSDSATRDPSTSVPASGAHQPPQTTEGEKSPEPLGLPQSQSAQALTPPPIPNGSAPEGPASPGSQ

SEQ ID NO: 815453 - protein, 884 aa, Homo sapiens
MFWKFDLHTSSHLDTLLEREDLSLPELLDEEDVLQECKVVNRKLLDFLLQPPHLQAMVAWVTQEPPDSGEERLRYKYPSVACEILTSDVPQINDALGADESLLNRLYGFLQSTGSLNPLLASFFSKVMGILINRKTDQLVSFLRKKDDFVDLLLQHIGTSAIMDLLLRLLTCVERPQLRQDVVNWLNEEKIVQRLIEQIHPSKDENQHSNASQSLCDIIRLSREQMIQVQDSPEPDQLLATLEKQETIEQLLSNMFEGEQSQSVIVSGIQVLLTLLEPRRPRSESVTVNSFFSSVDGQLELLAQGALESTVSSVGALHALRPRLSCFHQLLLEPPKLEPLQMTWGMLAPPLGNTRLHVVKLLASALSANDAALTHELLALDVPNTMLDLFFHYVFNNFLHAQVEGCVSTMLSLGPPPDSSPETPIQNPVVKHLLQQCRLVERILTSWEENDRVQCAGGPRKGYMGHLTRVAGALVQNTEKGPNAEQLRQLLKELPSEQQEQWEAFVSGPLAETNKKNMVDLVNTHHLHSSSDDEDDRLKEFNFPEEAVLQQAFMDFQMQRMTSAFIDHFGFNDEEFGEQEESVNAPFDKTANITFSLNADDENPNANLLEICYKDRIQQFDDDEEEEDEEEAQGSGESDGEDGAWQGSQLARGARLGQPPGVRVEAAQTALALSLQAPAGQPPLTQCLQMPRPAPESPGRKSCTLGLQPHRGPSVCPRASPLRAWPALLPVTPCSSGLRTPHPPQHLRKPQKAAKSRSPQPLARPWLASGTFRPPSTGSVLPPAPRTVQPETPLPLSQPPGPTSPPRPQKGRRAQSPWGFPKARVPRPSRLLRYPMALPRKGLHPQAPNSCLVRQRRPNLPSSRGSPGVGAGRVPRWPPLPSSP

SEQ ID NO: 815454 - protein, 810 aa, Homo sapiens
MFWKFDLHTSSHLDTLLEREDLSLPELLDEEDVLQECKVVNRKLLDFLLQPPHLQAMVAWVTQEPPDSGEERLRYKYPSVACEILTSDVPQINDALGADESLLNRLYGFLQSTGSLNPLLASFFSKVMGILINRKTDQLVSFLRKKDDFVDLLLQHIGTSAIMDLLLRLLTCVERPQLRQDVVNWLNEEKIVQRLIEQIHPSKDENQHSNASQSLCDIIRLSREQMIQVQDSPEPDQLLATLEKQETIEQLLSNMFEGEQSQSVIVSGIQVLLTLLEPRRPRSESVTVNSFFSSVDGQLELLAQGALESTVSSVGALHALRPRLSCFHQLLLEPPKLEPLQMTWGMLAPPLGNTRLHVVKLLASALSANDAALTHELLALDVPNTMLDLFFHYVFNNFLHAQVEGCVSTMLSLGPPPDSSPETPIQNPVVKHLLQQCRLVERILTSWEENDRVQCAGGPRKGYMGHLTRVAGALVQNTEKGPNAEQLRQLLKELPSEQQEQWEAFVSGPLAETNKKNMVDLVNTHHLHSSSDDEDDRLKEFNFPEEAVLQQAFMDFQMQRMTSAFIDHFGFNDEEFGEQEESVNAPFDKTANITFSLNADDENPNANLLEICYKDRIQQFDDDEEEEDEEEAQGSGESDGEDGAWQGSQLARGARLGQPPGVRSGGSTDSEDEEEEDEEEEEDEEGIGCAARGGATPLSYPSPGPQPPGPSWTATFDPVPTDAPTSPRVSGEEELHTGPPAPQGPLSVPQGLPTQSLASPPARDALQLRSQDPTPPSAPQEATEGWCQGDRPNPPPFALRREVLERCLLE

SEQ ID NO: 815455 - protein, 306 aa, Homo sapiens
SPCLAFSPSAPFDKTANITFSLNADDENPNANLLEICYKDRIQQFDDDEEEEDEEEAQGSGESDGEDGAWQGSQLARGARLGQPPGVRSGGSTDSEDEEEEDEEEEEDEEGIGCAARGGATPLSYPSPGPQPPGPSWTATFDPVPTDAPTSPRVSGEEELHTGPPAPQGPLSVPQGLPTQSLASPPARDALQLRSQDPTPPSAPQEATEGSKVTEPSAPCQALVSIGDLQATFHGIRSAPSSSDSATRDPSTSVPASGAHQPPQTTEGEKSPEPLGLPQSQSAQALTPPPIPNGSAPEGPASPGSQ

SEQ ID NO: 815456 - protein, 663 aa, Homo sapiens [sequence omitted]

SEQ ID NO: 815457 - protein, 685 aa, Homo sapiens
MFWKFDLHTSSHLDTLLEREDLSLPELLDEEDVLQECKVVNRKLLDFLLQPPHLQAMVAWVTQEPPDSGEERLRYKYPSVACEILTSDVPQINDALGADESLLNRLYGFLQSTGSLNPLLASFFSKVMGILINRKTDQLVSFLRKKDDFVDLLLQHIGTSAIMDLLLRLLTCVERPQLRQDVVNWLNEEKIVQRLIEQIHPSKDENQHSNASQSLCDIIRLSREQMIQVQDSPEPDQLLATLEKQETIEQLLSNMFEGEQSQSVIVSGIQVLLTLLEPRRPRSESVTVNSFFSSVDGQLELLAQGALESTVSSVGALHALRPRLSCFHQLLLEPPKLEPLQMTWGMLAPPLGNTRLHVVKLLASALSANDAALTHELLALDVPNTMLDLFFHYVFNNFLHAQVEGCVSTMLSLGPPPDSSPETPIQNPVVKHLLQQCRLVERILTSWEENDRVQCAGGPRKGYMGHLTRVAGALVQNTEKGPNAEQLRQLLKELPSEQQEQWEAFVSGPLAETNKKNMVDLVNTHHLHSSSDDEDDRLKEFNFPEEAVLQQAFMDFQMQRMTSAFIDHFGFNDEEFGEQEESVNAPFDKTANITFSLNADDENPNANLLEICYKDRIQQFDDDEEEEDEEEAQGSGESDGEDGAWQGSQLARGARLGQPPGVRVEAAQTVRTKKRGDDFKPKGSK

SEQ ID NO: 815458 - protein, 195 aa, Homo sapiens
MPRPAPESPGRKSCTLGLQPHRGPSVCPRASPLRAWPALLPVTPCSSGLRTPHPPQHLRKPQKAAKSRSPQPLARPWLASGTFRPPSTGSVLPPAPRTVQPETPLPLSQPPGPTSPPRPQKGRRAQSPWGFPKARVPRPSRLLRYPMALPRKGLHPQAPNSCLVRQRRPNLPSSRGSPGVGAGRVPRWPPLPSSP

SEQ ID NO: 815459 - protein, 629 aa, Homo sapiens
MFWKFDLHTSSHLDTLLEREDLSLPELLDEEDVLQECKVVNRKLLDFLLQPPHLQAMVAWVTQEPPDSGEERLRYKYPSVACEILTSDVPQINDALGADESLLNRLYGFLQSTGSLNPLLASFFSKVMGILINRKTDQLVSFLRKKDDFVDLLLQHIGTSAIMDLLLRLLTCVERPQLRQDVVNWLNEEKIVQRLIEQIHPSKDENQHSNASQSLCDIIRLSREQMIQVQDSPEPDQLLATLEKQETIEQLLSNMFEGEQSQSVIVSGIQVLLTLLEPRRPRSESVTVNSFFSSVDGQLELLAQGALESTVSSVGALHALRPRLSCFHQLLLEPPKLEPLQMTWGMLAPPLGNTRLHVVKLLASALSANDAALTHELLALDVPNTMLDLFFHYVFNNFLHAQVEGCVSTMLSLGPPPDSSPETPIQNPVVKHLLQQCRLVERILTSWEENDRVQCAGGPRKGYMGHLTRVAGALVQNTEKGPNAEQLRQLLKELPSEQQEQWEAFVSGPLAETNKKNMVDLVNTHHLHSSSDDEDDRLKEFNFPEEAVLQQAFMDFQMQRMTSAFIDHFGFNDEEFGEQEESVNAPFDKTANITFSLNADDENPNANRPGFATDLDSRPTWIRDRPGFA

SEQ ID NO: 815460 - protein, 630 aa, Homo sapiens
MFWKFDLHTSSHLDTLLEREDLSLPELLDEEDVLQECKVVNRKLLDFLLQPPHLQAMVAWVTQEPPDSGEERLRYKYPSVACEILTSDVPQINDALGADESLLNRLYGFLQSTGSLNPLLASFFSKVMGILINRKTDQLVSFLRKKDDFVDLLLQHIGTSAIMDLLLRLLTCVERPQLRQDVVNWLNEEKIVQRLIEQIHPSKDENQHSNASQSLCDIIRLSREQMIQVQDSPEPDQLLATLEKQETIEQLLSNMFEGEQSQSVIVSGIQVLLTLLEPRRPRSESVTVNSFFSSVDGQLELLAQGALESTVSSVGALHALRPRLSCFHQLLLEPPKLEPLQMTWGMLAPPLGNTRLHVVKLLASALSANDAALTHELLALDVPNTMLDLFFHYVFNNFLHAQVEGCVSTMLSLGPPPDSSPETPIQNPVVKHLLQQCRLVERILTSWEENDRVQCAGGPRKGYMGHLTRVAGALVQNTEKGPNAEQLRQLLKELPSEQQEQWEAFVSGPLAETNKKNMVDLVNTHHLHSSSDDEDDRLKEFNFPVPSQRELVLGVPRLPPTCPAVPRCSADGHAHTRPFSSGPPWGTAQRGWGCQRVPSGGRAFAQTLHFQPGQSGSGEQGPPRQQPQGP

SEQ ID NO: 815461 - protein, 136 aa, Homo sapiens
SASTRLGVTLRAGSPPARDALQLRSQDPTPPSAPQEATEGSKVTEPSAPCQALVSIGDLQATFHGIRSAPSSSDSATRDPSTSVPASGAHQPPQTTEGEKSPEPLGLPQSQSAQALTPPPIPNGSAPEGPASPGSQ

SEQ ID NO: 815462 - protein, 169 aa, Homo sapiens
EAGRRARRLSGFGEGVVKEVGLGFRRSLLGSAARLDRGGGLPSPPVGRSVCDCGNLVELPPSSLAECCLRGPRDPGSANPASCPPGPTSPPRPQKGRRAQSPWGFPKARVPRPSRLLRYPMALPRKGLHPQAPNSCLVRQRRPNLPSSRGSPGVGAGRVPRWPPLPSSP

SEQ ID NO: 815463 - protein, 111 aa, Homo sapiens
MSACVIGRGTERENSQSPGASPKPECPGPHASSDTQWLCPGRACIPRLPIAAWCGSGGQIFRPPVDLPGWGQGGSHDGPHCPHHPDTPTFSPLDPQEAGARETGPTHPHLH

SEQ ID NO: 815464 - protein, 79 aa, Homo sapiens
THAVESAQALWLWGSPKARVPRPSRLLRYPMALPRKGLHPQAPNSCLVRQRRPNLPSSRGSPGVGAGRVPRWPPLPSSP

SEQ ID NO: 815465 - protein, 412 aa, Homo sapiens
MFWKFDLHTSSHLDTLLEREDLSLPELLDEEDVLQECKVVNRKLLDFLLQPPHLQAMVAWVTQEPPDSGEERLRYKYPSVACEILTSDVPQINDALGADESLLNRLYGFLQSTGSLNPLLASFFSKVMGILINRKTDQLVSFLRKKDDFVDLLLQHIGTSAIMDLLLRLLTCVERPQLRQDVVNWLNEEKIVQRLIEQIHPSKDENQHSNASQSLCDIIRLSREQMIQVQDSPEPDQLLATLEKQETIEQLLSNMFEGEQSQSVIVSGIQVLLTLLEPRRPRSESVTVNSFFSSVDGQLELLAQGALESTVSSVGALHALRPRLSCFHQLLLEPPKLEPLQMTWGMLAPPLGNTRLHVVKLLASALSANDAALTHELLALDVPNTMLDSSHYVFHTSWLPVGVREPWWLGAL

SEQ ID NO: 815466 - protein, 124 aa, Homo sapiens
SGRESRRRPALYSPGAAAGAGAAGWLVAGGGAPMSPECEEPPPPLQGAMFWKFDLHTSSHLDTLLEREDLSLPELLDEEDVLQECKVVNRKLLDFLLQPPHLQAMVAWVTQEPPDSGEERLRYK

SEQ ID NO: 815467 - protein, 67 aa, Homo sapiens
YDPMMIEFRALVPRKRQQVRVLQSWALGDPQGKAHGREGTKGILGPTVHLSCPLFSPFHFCLQKAPS

SEQ ID NO: 815468 - protein, 204 aa, Homo sapiens
PAEPVEKGASTDICAFCHKTVSPRELAVEAMKRQYHAQCFTCRTCRRQLAGQSFYQKDGRPLCEPCYQDTLERCGKCGEVVRDHIIRALGQAFHPSCFTCVTCARCIGDESFALGSQNEVYCLDDFYRKFAPVCSICENPIIPRDGKDAFKIECMGRNFHENCYRCEDCRILLSVEPTDQGCYPLNNHLFCKPCHVKRSAAGCC

SEQ ID NO: 815469 - protein, 276 aa, Homo sapiens
MASKPEKRVASSVFITLAPPRRDVAVAEEVRQAVCEARRGRPWEAPAPMKTPEAGLAGRPSPWTTPGRAAATVPAAPMQLFNGDICAFCHKTVSPRELAVEAMKRQYHAQCFTCRTCRRQLAGQSFYQKDGRPLCEPCYQDTLERCGKCGEVVRDHIIRALGQAFHPSCFTCVTCARCIGDESFALGSQNEVYCLDDFYRKFAPVCSICENPIIPRDGKDAFKIECMGRNFHENCYRCEDCRILLSVEPTDQGCYPLNNHLFCKPCHVKRSAAGCC

SEQ ID NO: 815470 - protein, 92 aa, Homo sapiens
WLWHERLPSMGSFASRKFAPVCSICENPIIPRDGKDAFKIECMGRNFHENCYRCEDCRILLSVEPTDQGCYPLNNHLFCKPCHVKRSAAGCC

SEQ ID NO: 815471 - protein, 97 aa, Homo sapiens
LPRRNRHLCSPIATGLKLLRRKFAPVCSICENPIIPRDGKDAFKIECMGRNFHENCYRCEDCRILLSVEPTDQGCYPLNNHLFCKPCHVKRSAAGCC

SEQ ID NO: 815472 - protein, 276 aa, Homo sapiens; identical to SEQ ID NO: 815469

SEQ ID NO: 815473 - protein, 103 aa, Homo sapiens
MASKPEKRVASSVFITLAPPRRDVAVAEEVRQAVCEARRGRPWEAPAPMKTPEAGLAGRPSPWTTPGRAAATVPAAPMQLFNGGCPPPPPVLDGEDVLPDLDL

SEQ ID NO: 815474 - protein, 551 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 815475 - protein, 520 aa, Homo sapiens
GLEAKIRHRNSIKTRLFLCVRNFAWEIKLDLELSDRESEAWDMDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 815476 - protein, 459 aa, Homo sapiens
MIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 815477 - protein, 462 aa, Homo sapiens
MIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGYGPSLRLLAPPGAVKGTGQEHQGQGCHYAGGHRFLFPRLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNASMTRSQDKAGRGRSQA

SEQ ID NO: 815478 - protein, 250 aa, Homo sapiens
MVKTNKPGAKVAVSAQRGSEVTTNTSPQQGHGYVLASSHRSAAVSLNPSHRRSEAAHPTTPHSASDYPRSVSLQSGPGHYAVPTPRGTETGPRTESSRHSSPHLKSQKTQTLASHASSRQWKVSPPREEAARRGSESKSGREVGHHASSIPDAKSTHQLSFQDQKNNLQSQILEDDPPSKVQNPQGVRVPRRILSYPKDEAVQTEPIQRITTTSEIRSPRSPSLLEHGSSCVSADYQTAQRRVPVEESET

SEQ ID NO: 815479 - protein, 75 aa, Homo sapiens
KDSPKVPILMPVPIPAAADAGDATQNTKTDEGELLTGFQPWIFKSPPLLPVHAGPSQHQLCSGPFSYCHFALHPC

SEQ ID NO: 815480 - protein, 483 aa, Homo sapiens
MGPVPTSFGKRRGGPQTLPASPGGMIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 815481 - protein, 474 aa, Homo sapiens
MVQARPSRALPVWAEGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 815482 - protein, 589 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGYGPSLRLLAPPGAVKGTGQEHQGQGCHYAGGHRFLFPRLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 815483 - protein, 519 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 815484 - protein, 674 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEVEPPALPLPFSGLLQEDRGQGAECVCVCVCVCVCVCVVCVCIWDLFQSCVSPSSKISAPKGTGNLQFQQGQEAQLVASDGNSQKSGTAFLRLGQRPERERRLALGAGAPLAPHRDAFCLPVYKDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 815485 - protein, 360 aa, Homo sapiens
MDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 815486 - protein, 582 aa, Homo sapiens
MIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEVEPPALPLPFSGLLQEDRGQGAECVCVCVCVCVCVCVVCVCIWDLFQSCVSPSSKISAPKGTGNLQFQQGQEAQLVASDGNSQKSGTAFLRLGQRPERERRLALGAGAPLAPHRDAFCLPVYKDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 815487 - protein, 452 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 815488 - protein, 551 aa, Homo sapiens; identical to SEQ ID NO: 815474

SEQ ID NO: 815489 - protein, 384 aa, Homo sapiens
MGPVPTSFGKRRGGPQTLPASPGGMDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 815490 - protein, 490 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGYGPSLRLLAPPGAVKGTGQEHQGQGCHYAGGHRFLFPRLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 815491 - protein, 449 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEATCRT

SEQ ID NO: 815492 - protein, 516 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNASMTRSQDKAGRGRSQA

SEQ ID NO: 815493 - protein, 559 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLLQIPPSLFSVHCRGLPTPN

SEQ ID NO: 815494 - protein, 510 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKRKYDQKPGQSWQGEIPSLALGETKPYFCSSIGPGLNLSGCWGPPRLINPFLPLAN

SEQ ID NO: 815495 - protein, 502 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNATN

SEQ ID NO: 815496 - protein, 469 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEAQQTDSGKWYRLPHPCCPTRDRSRN

SEQ ID NO: 815497 - protein, 502 aa, Homo sapiens; identical to SEQ ID NO: 815495

SEQ ID NO: 815498 - protein, 502 aa, Homo sapiens; identical to SEQ ID NO: 815495

SEQ ID NO: 815499 - protein, 190 aa, Homo sapiens
PAAVRTRGGGRVTAVLRGRRAAPPRVARALSRRSRPRPGCSHGASTNFIWKTQRRPTNTACLTRRDGKTLGPSFPQPDKGQSLALSQRDPREGEAQPTILPGGISYILLPLGQEPWESFLLLHLPAPSPPARSLCSVWGWGHPSLPPACSGKRNSNPSQPPWRCPGRKFLMLGSEDVISSPDIVARACHK

SEQ ID NO: 815500 - protein, 267 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEGKERRGQSGRLALGN

SEQ ID NO: 815501 - protein, 244 aa, Homo sapiens
QGKGRRRGVGKDIPQAFLAPARDRRGSKRKGKEQARKPDNNSIKTRLFLCVRNFAWEIKLDLELSDRESEAWDMDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEVEPPALPLPFSGLLQEDRGQGAECVCVCVCVCVCVCVCVCVYLGPISVLCQP

SEQ ID NO: 815502 - protein, 80 aa, Homo sapiens
TDTSRSGPQETQSEGSWWWEGIRWASRKDVVPRTVGPSSVCQIREEIEHFGIKIYQFPDCDSDEDEDFKLQDQALKVGPL

SEQ ID NO: 815503 - protein, 410 aa, Homo sapiens
MVLSQRQRDELNRAIADYLRSNGYEEAYSVFKKEAELDVNEELDKKYAGLLEKKWTSVIRLQKKVMELESKLNEAKEEFTSGGPLGQKRDPKEWIPRPPEKYALSGHRSPVTRVIFHPVFSVMVSASEDATIKVWDYETGDFERTLKGHTDSVQDISFDHSGKLLASCSADMTIKLWDFQGFECIRTMHGHDHNVSSVAIMPNGDHIVSASRDKTIKMWEVQTGYCVKTFTGHREWVRMVRPNQDGTLIASCSNDQTVRVWVVATKECKAELREHEHVVECISWAPESSYSSISEATGSETKKSGKPGPFLLSGSRDKTIKMWDVSTGMCLMTLVGHDNWVRGVLFHSGGKFILSCADDKTLRVWDYKNKRCMKTLNAHEHFVTSLDFHKTAPYVVTGSVDQTVKVWECR

SEQ ID NO: 815504 - protein, 410 aa, Homo sapiens; identical to SEQ ID NO: 815503

SEQ ID NO: 815505 - protein, 288 aa, Homo sapiens [sequence omitted]

SEQ ID NO: 815506 - protein, 410 aa, Homo sapiens; identical to SEQ ID NO: 815503

SEQ ID NO: 815507 - protein, 372 aa, Homo sapiens
MRLNKIKIKKLARCGSTHLLLDYKKKVMELESKLNEAKEEFTSGGPLGQKRDPKEWIPRPPEKYALSGHRSPVTRVIFHPVFSVMVSASEDATIKVWDYETGDFERTLKGHTDSVQDISFDHSGKLLASCSADMTIKLWDFQGFECIRTMHGHDHNVSSVAIMPNGDHIVSASRDKTIKMWEVQTGYCVKTFTGHREWVRMVRPNQDGTLIASCSNDQTVRVWVVATKECKAELREHEHVVECISWAPESSYSSISEATGSETKKSGKPGPFLLSGSRDKTIKMWDVSTGMCLMTLVGHDNWVRGVLFHSGGKFILSCADDKTLRVWDYKNKRCMKTLNAHEHFVTSLDFHKTAPYVVTGSVDQTVKVWECR

SEQ ID NO: 815508 - protein, 410 aa, Homo sapiens; identical to SEQ ID NO: 815503

SEQ ID NO: 815509 - protein, 410 aa, Homo sapiens; identical to SEQ ID NO: 815503

SEQ ID NO: 815510 - protein, 410 aa, Homo sapiens; identical to SEQ ID NO: 815503

SEQ ID NO: 815511 - protein, 410 aa, Homo sapiens; identical to SEQ ID NO: 815503

SEQ ID NO: 815512 - protein, 410 aa, Homo sapiens; identical to SEQ ID NO: 815503

SEQ ID NO: 815513 - protein, 410 aa, Homo sapiens; identical to SEQ ID NO: 815503

SEQ ID NO: 815514 - protein, 410 aa, Homo sapiens; identical to SEQ ID NO: 815503

SEQ ID NO: 815515 - protein, 995 aa, Homo sapiens
MKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 815516 - protein, 441 aa, Homo sapiens
CPFLNPAWPSRAWDPKFNCKGWDSALPPMSCEASAITDFFVPFLLFWLFLLMMTLGACSHEECGAYTVLPSWLFLCLLLQGPGIHFSSDVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 815517 - protein, 2314 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 815518 - protein, 2295 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDEQYQFLYKVILSLVSTRQEENPSTSLDSNGAALPDGNIAESLESLV

SEQ ID NO: 815519 - protein, 2307 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFEEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 815520 - protein, 2028 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDFRHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 815521 - protein, 2353 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQGLTLSPRLECRGTISAHCNLPLPGLTDPPTSASRVARTILLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 815522 - protein, 1989 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTESSFLDQQAKQS

SEQ ID NO: 815523 - protein, 1473 aa, Homo sapiens
EYSYETYLSCLFPQASELYKPILCNSKEQADFSCEKFSDLKSDFFTLHLTFPFHLLSNLVCASLGKEAFVCLNFAILKDLVVGTSVAIFLWKSKFLCKFNLVLFPKSINCLKTRTTSSSVRPSQSLHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 815524 - protein, 1218 aa, Homo sapiens
WNLTNLMIKNLSGGMSKVISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 815525 - protein, 1321 aa, Homo sapiens
TLRDRPREGGAEPAKGAHRHRGRQPVTGTPPERSTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDRDSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 815526 - protein, 1455 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 815527 - protein, 502 aa, Homo sapiens
MIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 815528 - protein, 502 aa, Homo sapiens; identical to SEQ ID NO: 815527

SEQ ID NO: 815529 - protein, 502 aa, Homo sapiens; identical to SEQ ID NO: 815527

SEQ ID NO: 815530 - protein, 1615 aa, Homo sapiens
MFPLIGKTIIFDNFPDPSDTWEITETIGKGTYGKVFKVLNKKNGQKAAVKILDPIHDIDEEIEAEYNILKALSDHPNVVRFYGIYFKKDKVNGDKLWLVLELCSGGSVTDLVKGFLKRGERMSEPLIAYILHEALMGLQHLHNNKTIHRDVKGNNILLTTEGGVKLVDFGVSAQLTSTRHRRNTSVGTPFWMAPEVIACEQQLDTTYDARCDTWSLGITAIELGDGDPPLADLHPMRALFKIPRNPPPKLRQPELWSAEFNDFISKCLTKDYEKRPTVSELLQHKFITQIEGKDVMLQKQLTEFIGIHQCMGGTEKARRERIHTKKGNFNRPLISNLKDVDDLATLEILDENTVSEQLEKCYSRDQIYVYVGDILIALNPFQSLGLYSTKHSKLYIGSKRTASPPHIFAMADLGYQSIITYNSDQCIVISGESGAGKTENAHLLVQQLTVLGKANNRTLQEKILQVNNLVEAFGNACTIINDNSSRFGKYLEMKFTSSGAVVGAQISEYLLEKSRVIHQAIGEKNFHIFYYIYAGLAEKKKLAHYKLPENKPPRYLQNDHLRTVQDIMNNSFYKSQYELIEQCFKVIGFTMEQLGSIYSILAAILNVGNIEFSSVATEHQIDKSHISNHTALENCVSLLCIRADELQEALTSHCVVTRGETIIRPNTVEKATDVRDAMAKTLYGRLFSWIVNCINSLLKHDSSPSGNGDELSIGILDIFGFENFKKNSFEQLCINIANEQIQYYYNQHVFAWEQNEYLNEDVDARVIEYEDNWPLLDMFLQKPMGLLSLLDEESRFPKATDQTLVEKFEGNLKSQYFWRPKRMELSFGIHHYAGKVLYNASGFLAKNKTLVPTDIVLLLRSSDNSVIRQLVNHPLTKTGNLPHSKLKMLNYQMRTSEKLINLAKGDTGEATRHARETTNMKTQTVASYFRYSLMDLLSKMVVGQPHFVRCIKPNSERQARKYDKEKVLLQLRYTGILETARIRRLGFSHRILFANFIKRYYLLCYKSSEEPRMSPDTCATILEKAGLDNWALGKTKVFLKYYHVEQLNLMRKEAIDKLILIQACVRAFLCSRRYQKIQEKRKESAIIIQSAARGHLVRKQRKEIVDMKNTAVTTIQTSDQEFDYKKNFENTRESFVKKQAENAISANERFISAPNNKGSVSVVKTSTFKPEEETTNAVESNNRVYQTPKKMNNVYEEEVKQEFYLVGPEVSPKQKSVKDLEENSNLRKVEKEEAMIQSYYQRYTEERNCEESKAAYLERKAISERPSYPVPWLAENETSFKKTLEPTLSQRSIYQNANSMEKEKKTSVVTQSAPICSQEEGRGRLRHETVKERQVEPVTQAQEEEDKAAVFIQSKYRGYKRRQQLRKDKMSSFKHQKIVTTPTEVARNTHNLYSYPTKHEEINNIKKKDNKDSKATSEREACGLAIFSKQISKLSEEYFILQKKLNEMILSQQLKSLYLGVSHHKPINRRVSSQQCLSGVCKGEEPKILRPPRRPRKPKTLNNPEDSTYYYLLHKSIQEEKRRPRKDSQGKLLDLEDFYYKEFLPSRSGPKEHSPSLRERRPQQELQNQCIKANERCWAAESPEKEEEREPAANPYDFRRLLRKTSQRRRLVQQS

SEQ ID NO: 815531 - protein, 1504 aa, Homo sapiens
MFPLIGKTIIFDNFPDPSDTWEITETIGKGTYGKVFKVLNKKNGQKAAVKILDPIHDIDEEIEAEYNILKALSDHPNVVRFYGIYFKKDKVNGDKLWLVLELCSGGSVTDLVKGFLKRGERMSEPLIAYILHEALMGLQHLHNNKTIHRDVKGNNILLTTEGGVKLVDFGVSAQLTSTRHRRNTSVGTPFWMAPEVIACEQQLDTTYDARCDTWSLGITAIELGDGDPPLADLHPMRALFKIPRNPPPKLRQPELWSAEFNDFISKCLTKDYEKRPTVSELLQHKFITQIEGKDVMLQKQLTEFIGIHQCMGGTEKARRERIHTKKGNFNRPLISNLKDVDDLATLEILDENTVSEQLEKCYSRDQIYVYVGDILIALNPFQSLGLYSTKHSKLYIGSKRTASPPHIFAMADLGYQSIITYNSDQCIVISGESGAGKTENAHLLVQQLTVLGKANNRTLQEKILQVNNLVEAFGNACTIINDNSSRFGKYLEMKFTSSGAVVGAQISEYLLEKSRVIHQAIGEKNFHIFYYIYAGLAEKKKLAHYKLPENKPPRYLQNDHLRTVQDIMNNSFYKSQYELIEQCFKVIGFTMEQLGSIYSILAAILNVGNIEFSSVATEHQIDKSHISNHTALENCVSLLCIRADELQEALTSHCVVTRGETIIRPNTVEKATDVRDAMAKTLYGRLFSWIVNCINSLLKHDSSPSGNGDELSIGILDIFGFENFKKNSFEQLCINIANEQIQYYYNQHVFAWEQNEYLNEDVDARVIEYEDNWPLLDMFLQKPMGLLSLLDEESRFPKATDQTLVEKFEGNLKSQYFWRPKRMELSFGIHHYAGKVLYNASGFLAKNKTLVPTDIVLLLRSSDNSVIRQLVNHPLTKTGNLPHSKLKMLNYQMRTSEKLINLAKGDTGEATRHARETTNMKTQTVASYFRYSLMDLLSKMVVGQPHFVRCIKPNSERQARKYDKEKVLLQLRYTGILETARIRRLGFSHRILFANFIKRYYLLCYKSSEEPRMSPDTCATILEKAGLDNWALGKTKVFLKYYHVEQLNLMRKEAIDKLILIQACVRAFLCSRRYQKIQEKRKESAIIIQSAARGHLVRKQRKEIVDMKNTAVTTIQTSDQEFDYKKNFENTRESFVKKQAENAISANERFISAPNNKGSVSVVKTSTFKPEEETTNAVESNNRVYQTPKKMNNVYEEEVKQEFYLVGPEVSPKQKSVKDLEENSNLRKVEKEEAMIQSYYQRYTEERNCEESKAAYLERKAISERPSYPVPWLAENETSFKKTLEPTLSQRSIYQNANSMEKEKKTSVVTQSAPICSQEEGRGRLRHETVKERQVEPVTQAQEEEDKAAVFIQSKYRGYKRRQQLRKDKMSSFKHQKIVTTPTEVARNTHNLYSYPTKHEEINNIKKKDNKDSKATSEREACGLAIFSKQISKLSEEYFILQKKLNEMILSQQLKSLYLGVSHHKPINRRVSSQQCLSEVNPRRKTKTKERQSGKIIRFGRFLL

SEQ ID NO: 815532 - protein, 492 aa, Homo sapiens
MSPDTCATILEKAGLDNWALGKTKVFLKYYHVEQLNLMRKEAIDKLILIQACVRAFLCSRRYQKIQEKRKESAIIIQSAARGHLVRKQRKEIVDMKNTAVTTIQTSDQEFDYKKNFENTRESFVKKQAENAISANERFISAPNNKGSVSVVKTSTFKPEEETTNAVESNNRVYQTPKKMNNVYEEEVKQEFYLVGPEVSPKQKSVKDLEENSNLRKVEKEEAMIQSYYQRYTEERNCEESKAAYLERKAISERPSYPVPWLAENETSFKKTLEPTLSQRSIYQNANSMEKEKKTSVVTQSAPICSQEEGRGRLRHETVKERQVEPVTQAQEEEDKAAVFIQSKYRGYKRRQQLRKDKMSSFKHQKIVTTPTEVARNTHNLYSYPTKHEEINNIKKKDNKDSKATSEREACGLAIFSKQISKLSEEYFILQKKLNEMILSQQLKSLYLGVSHHKPINRRVSSQQCLSEVNPRRKTKTKERQSGKIIRFGRFLL

SEQ ID NO: 815533 - protein, 1504 aa, Homo sapiens; identical to SEQ ID NO: 815531

SEQ ID NO: 815534 - protein, 247 aa, Homo sapiens
MFPLIGKTIIFDNFPDPSDTWEITETIGKGTYGKVFKVLNKKNGQKAAVKILDPIHDIDEEIEAEYNILKALSDHPNVVRFYGIYFKKDKVNGDKLWLVLELCSGGSVTDLVKGFLKRGERMSEPLIAYILHEALMGLQHLHNNKTIHRDVKGNNILLTTEGGVKLVDFGVSAQLTSTRHRRNTSVGTPFWMAPEVIACEQQLDTTYDARCDTWSLGITAIELGDGDPPLADLHPMRALFKIPRSDD

SEQ ID NO: 815535 - protein, 604 aa, Homo sapiens
MASNPERGEILLTELQGDSRSLPFSENVSAVQKLDFSDTMVQQKLDDIKDRIKREIRKELKIKEGAENLRKVTTDKKSLAYVDNILKKSNKKLEELHHKLQELNAHIVVSDPEDITDCPRTPDTPNNDPRCSTSNNRLKALQKQLDIELKVKQGAENMIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQRQKKIFSKQQGKTFLRAPQMNINIATWGRLVRRAIPTVNHSGTFSPQAPVPTTVPVVDVRIPQLAPPARYVSEILSISYTKLLGHSYVLIIAGVLSLAFFPSSILKVVFCLLKK

SEQ ID NO: 815536 - protein, 917 aa, Homo sapiens
MASNPERGEILLTELQGDSRSLPFSENVSAVQKLDFSDTMVQQKLDDIKDRIKREIRKELKIKEGAENLRKVTTDKKSLAYVDNILKKSNKKLEELHHKLQELNAHIVVSDPEDITDCPRTPDTPNNDPRCSTSNNRLKALQKQLDIELKVKQGAENMIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQRQKKIFSKQQGKTFLRAPQMNINIATWGRLVRRAIPTVNHSGTFSPQAPVPTTVPVVDVRIPQLAPPASDSTVTKLDFDLEPEPPPAPPRASSLGEIDESSELRVLDIPGQDSETVFDIQNDRNSILPKSQSEYKPDTPQSGLEYSGIQELEDRRSQQRFQFNLQDFRCCAVLGRGHFGKVLLAEYKNTNEMFAIKALKKGDIVARDEVDSLMCEKRIFETVNSVRHPFLVNLFACFQTKEHVCFVMEYAAGGDLMMHIHTDVFSEPRAVFYAACVVLGLQYLHEHKIVYRDLKLDNLLLDTEGFVKIADFGLCKEGMGYGDRTSTFCGTPEFLAPEVLTETSYTRAVDWWGLGVLIYEMLVGESPFPGDDEEEVFDSIVNDEVRYPRFLSTEAISIMRRLLRRNPERRLGASEKDAEDVKSTHFSG

SEQ ID NO: 815537 - protein, 917 aa, Homo sapiens; identical to SEQ ID NO: 815536

SEQ ID NO: 815538 - protein, 917 aa, Homo sapiens; identical to SEQ ID NO: 815536

SEQ ID NO: 815539 - protein, 917 aa, Homo sapiens; identical to SEQ ID NO: 815536

SEQ ID NO: 815540 - protein, 917 aa, Homo sapiens; identical to SEQ ID NO: 815536

SEQ ID NO: 815541 - protein, 855 aa, Homo sapiens
MASNPERGEILLTELQGDSRSLPFSENVSAVQKLDFSDTMVQQKLDDIKDRIKREIRKELKIKEGAENLRKVTTDKKSLAYVDNILKKSNKKLEELHHKLQELNAHIVVSDPEDITDCPRTPDTPNNDPRCSTSNNRLKALQKQLDIELKVKQGAENMIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTDDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQRQKKIFSKQQGKTFLRAPQMNINIATWGRLVRRAIPTVNHSGTFSPQAPVPTTVPVVDVRIPQLAPPASDSTVTKLDFDLEPEPPPAPPRASSLGEIDESSELRVLDIPGQDSETVFDIQNDRNSILPKSQSEYKPDTPQSGLEYSGIQELEDRRSQQRFQFNLQDFRCCAVLGRGHFGKVLLAEYKNTNEMFAIKALKKGDIVARDEVDSLMCEKRIFETVNSVRHPFLVNLFACFQTKEHVCFVMEYAAGGDLMMHIHTDVFSEPRAVFYAACVVLGLQYLHEHKIVYRDLKLDNLLLDTEGFVKIADFGLCKEGMGYGDRTSTFCGTPEFLAPEVLTETSYTRAVDWWGLGVLIYEMLVGESPFPGDDEEEVFDSIVNDEVRYPRFLSTEAISIMRRLLRRNPERRLGASEKDAEDVKSTHFSG

SEQ ID NO: 815542 - protein, 917 aa, Homo sapiens; identical to SEQ ID NO: 815536

SEQ ID NO: 815543 - protein, 262 aa, Homo sapiens
MRNSYRFLASSLSVVVSLLLIPEDVCEKIIGGNEVTPHSRPYMVLLSLDRKTICAGALIAKDWVLTAAHCNLNKRSQVILGAHSITREEPTKQIMLVKKEFPYPCYDPATREGDLKLLQLTEKAKINKYVTILHLPKKGDDVKPGTMCQVAGWGRTHNSASWSDTLREVNITIIDRKVCNDRNHYNFNPVIGMNMVCAGSLRGGRDSCNGDSGSPLLCEGVFRGVTSFGLENKCGDPRGPGVYILLSKKHLNWIIMTIKGAV

SEQ ID NO: 815544 - protein, 305 aa, Homo sapiens
MMDQKTCNDAEHYNFKLVVENCMICASGRKGEDAGRLPRWPNRNSSRLQLPARSMRKTSDFCISNSDVCEKIIGGNEVTPHSRPYMVLLSLDRKTICAGALIAKDWVLTAAHCNLNKRSQVILGAHSITREEPTKQIMLVKKEFPYPCYDPATREGDLKLLQLTEKAKINKYVTILHLPKKGDDVKPGTMCQVAGWGRTHNSASWSDTLREVNITIIDRKVCNDRNHYNFNPVIGMNMVCAGSLRGGRDSCNGDSGSPLLCEGVFRGVTSFGLENKCGDPRGPGVYILLSKKHLNWIIMTIKGAV

SEQ ID NO: 815545 - protein, 305 aa, Homo sapiens; identical to SEQ ID NO: 815544

SEQ ID NO: 815546 - protein, 305 aa, Homo sapiens; identical to SEQ ID NO: 815544

SEQ ID NO: 815547 - protein, 220 aa, Homo sapiens [sequence omitted]

SEQ ID NO: 815548 - protein, 305 aa, Homo sapiens; identical to SEQ ID NO: 815544

SEQ ID NO: 815549 - protein, 305 aa, Homo sapiens; identical to SEQ ID NO: 815544

SEQ ID NO: 815550 - protein, 305 aa, Homo sapiens; identical to SEQ ID NO: 815544

SEQ ID NO: 815551 - protein, 264 aa, Homo sapiens
YEISLPSTQEPPLAATDSLNFPPLHDVCEKIIGGNEVTPHSRPYMVLLSLDRKTICAGALIAKDWVLTAAHCNLNKRSQVILGAHSITREEPTKQIMLVKKEFPYPCYDPATREGDLKLLQLTEKAKINKYVTILHLPKKGDDVKPGTMCQVAGWGRTHNSASWSDTLREVNITIIDRKVCNDRNHYNFNPVIGMNMVCAGSLRGGRDSCNGDSGSPLLCEGVFRGVTSFGLENKCGDPRGPGVYILLSKKHLNWIIMTIKGAV

SEQ ID NO: 815552 - protein, 149 aa, Homo sapiens
MFFFQQLTEKAKINKYVTILHLPKKGDDVKPGTMCQVAGWGRTHNSASWSDTLREVNITIIDRKVCNDRNHYNFNPVIGMNMVCAGSLRGGRDSCNGDSGSPLLCEGVFRGVTSFGLENKCGDPRGPGVYILLSKKHLNWIIMTIKGAV

SEQ ID NO: 815553 - protein, 107 aa, Homo sapiens [sequence omitted]

SEQ ID NO: 815554 - protein, 696 aa, Homo sapiens
MAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSPVRGRGRPSPPRAERPEREKERRVANNARERLRVRDINEAFKELGRMCQTAPQQSEKPQTKLLILHQAVLGHPELGAASARAEPESQSSLFETARRGKGVRCGWRPPDGAFSSPPRPERSPQPRRAHVKGMPPWDEPPAFSPVLWPQNGHSRPRASSTSTPHTPVVSIEPTPT

SEQ ID NO: 815555 - protein, 462 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 815556 - protein, 141 aa, Homo sapiens
QQLRGQAEEAQGPLLLLHGCALWPPMEGGRIQAGPPCPGQKILESWALPVSVLRDKGPARPAPGPRSSSRPLLRRELLPHAGFWSPHWACSWVMRFGSTLTGCQPPARWVSLCCCFSKGRPHFPHWQVGTGRPWASPELMG

SEQ ID NO: 815557 - protein, 696 aa, Homo sapiens; identical to SEQ ID NO: 815554

SEQ ID NO: 815558 - protein, 798 aa, Homo sapiens
MAPVGTDKELSDLLDFSMMFPLPVTNGKGRPASLAGAQFGGSGLEDRPSSGSWGSGDQSSSSFDPSRVGVPVRPETLSFLSPELGARGVGKLRLREGASLPGVWTGGHGFESCLSSCNAGWRGGLWSPSTSHPHPISPRPSARAPTSLSRTAASLHPHSWDRDSEGGECLAWCGPSAVHRCADVGLGMVSARTAPGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSPVRGRGRPSPPRAERPEREKERRVANNARERLRVRDINEAFKELGRMCQTAPQQSEKPQTKLLILHQAVLGHPELGAASARAEPESQSSLFETARRGKGVRCGWRPPDGAFSSPPRPERSPQPRRAHVKGMPPWDEPPAFSPVLWPQNGHSRPRASSTSTPHTPVVSIEPTPT

SEQ ID NO: 815559 - protein, 657 aa, Homo sapiens
MAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSPVRGRGRPSPPRAERPEREKERRVANNARERLRVRDINEAFKELGRMCQTAPQQSEKPQTKLLILHQAVLGHPELGAASARAEPESQSSLFETARRGKGVRCGWRPPDGAFSSPPRPERSPQPRRAHVKAVNKT

SEQ ID NO: 815560 - protein, 696 aa, Homo sapiens; identical to SEQ ID NO: 815554

SEQ ID NO: 815561 - protein, 622 aa, Homo sapiens
MAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSPVRGRGRPSPPRAERPEREKERRVANNARERLRVRDINEAFKELGRMCQTAPQQSEKPQTKLLILHQAVLGHPELGAASARAEPESQSSLFETARRGQA

SEQ ID NO: 815562 - protein, 726 aa, Homo sapiens
MAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSPVRGRGRPSPPRAERPEREKERRVANNARERLRVRDINEAFKELGRMCQTAPQQSEKPQTKLLILHQAVLGHPELGAASASSTDEVLSLEEKDLRDRERRMANNARERVRVRDINEAFRELGRMCQMHLKSDKAQTKLLILQQAVQVILGLEQQVRERNLNPKAACLKRREEEKVSGVVGDPQMVLSAPHPGLSEAHNPAGHM

SEQ ID NO: 815563 - protein, 684 aa, Homo sapiens
MAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTRAERPEREKERRVANNARERLRVRDINEAFKELGRMCQTAPQQSEKPQTKLLILHQAVLGHPELGAASARAEPESQSSLFETARRGKGVRCGWRPPDGAFSSPPRPERSPQPRRAHVKGMPPWDEPPAFSPVLWPQNGHSRPRASSTSTPHTPVVSIEPTPT

SEQ ID NO: 815564 - protein, 714 aa, Homo sapiens
MAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTRAERPEREKERRVANNARERLRVRDINEAFKELGRMCQTAPQQSEKPQTKLLILHQAVLGHPELGAASASSTDEVLSLEEKDLRDRERRMANNARERVRVRDINEAFRELGRMCQMHLKSDKAQTKLLILQQAVQVILGLEQQVRERNLNPKAACLKRREEEKVSGVVGDPQMVLSAPHPGLSEAHNPAGHM

SEQ ID NO: 815565 - protein, 642 aa, Homo sapiens
MAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSPVRGRGRPSPPRAERPEREKERRVANNARERLRVRDINEAFKELGRMCQTAPQQSEKPQTKLLILHQAVLGHQRNLNPKAACLKRREEEKVSGVVGDPQMVLSAPHPGLSEAHNPAGHM

SEQ ID NO: 815566 - protein, 645 aa, Homo sapiens [sequence omitted]

SEQ ID NO: 815567 - protein, 645 aa, Homo sapiens [sequence omitted]

SEQ ID NO: 815568 - protein, 696 aa, Homo sapiens; identical to SEQ ID NO: 815554

SEQ ID NO: 815569 - protein, 723 aa, Homo sapiens
MAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVSAGRGWSWAVGGDPAPPDAPVSPRLQVGGSHPEDGLAGSTSLMHNHAALPSQPGTLPDLSRPPDSYSGLGRAGATAAASEIKREEKEDEENTSAADHSEEEKKELKAPRARTSPVRGRGRPSPPRAERPEREKERRVANNARERLRVRDINEAFKELGRMCQTAPQQSEKPQTKLLILHQAVLGHPELGAASARAEPESQSSLFETARRGKGVRCGWRPPDGAFSSPPRPERSPQPRRAHVKGMPPWDEPPAFSPVLWPQNGHSRPRASSTSTPHTPVVSIEPTPT

SEQ ID NO: 815570 - protein, 696 aa, Homo sapiens; identical to SEQ ID NO: 815554

SEQ ID NO: 815571 - protein, 645 aa, Homo sapiens [sequence omitted]

SEQ ID NO: 815572 - protein, 649 aa, Homo sapiens
MNQPQRMAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLVGGSHPEDGLAGSTSLMHNHAALPSQPGTLPDLSRPPDSYSGLGRAGATAAASEIKREEKEDEENTSAADHSEEEKKELKAPRARTSPVRGRGRPSPPRAERPEREKERRVANNARERLRVRDINEAFKELGRMCQTAPQQSEKPQTKLLILHQAVLGHPELGAASARAEPESQSSLFETARRGKGVRCGWRPPDGAFSSPPRPERSPQPRRAHVKGMPPWDEPPAFSPVLWPQNGHSRPRASSTSTPHTPVVSIEPTPT

SEQ ID NO: 815573 - protein, 696 aa, Homo sapiens; identical to SEQ ID NO: 815554

SEQ ID NO: 815574 - protein, 696 aa, Homo sapiens; identical to SEQ ID NO: 815554

SEQ ID NO: 815575 - protein, 753 aa, Homo sapiens
MNQPQRMAPVGTDKELSDLLDFSMMFPLPVTNGKGRPASLAGAQFGGSGLEDRPSSGSWGSGDQSSSSFDPSRVGVPVRPETLSFLSPELGARGVGKLRLREGASLPGVWTGGHGFESCLSSCNAGWRGGLWSPSTSHPHPISPRPSARAPTSLSRTAASLHPHSWDRDSEGGECLAWCGPSAVHRCADVGLGMVSARTAPGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSSTDEVLSLEEKDLRDRERRMANNARERVRVRDINEAFRELGRMCQMHLKSDKAQTKLLILQQAVQVILGLEQQVRERNLNPKAACLKRREEEKVSGVVGDPQMVLSAPHPGLSEAHNPAGHM

SEQ ID NO: 815576 - protein, 657 aa, Homo sapiens; identical to SEQ ID NO: 815559

SEQ ID NO: 815577 - protein, 657 aa, Homo sapiens; identical to SEQ ID NO: 815559

SEQ ID NO: 815578 - protein, 709 aa, Homo sapiens
MAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSPVRGRGRPSPPRAERPEREKERRVANNARERLRVRDINEAFKELGRMCQTAPQQSEKPQTKLLILHQAVLGHPELGAASARAEPESQSSLFETARRGKGVRCGWRPPDGAFSSPPRPERSPQPRRAHVKGLGGQWPHSLWNCAFCIEFKRDSPSARRKKQQFLGTTIMGGGGCDLSASRWFSKKFF

SEQ ID NO: 815579 - protein, 657 aa, Homo sapiens; identical to SEQ ID NO: 815559

SEQ ID NO: 815580 - protein, 726 aa, Homo sapiens; identical to SEQ ID NO: 815562

SEQ ID NO: 815581 - protein, 726 aa, Homo sapiens; identical to SEQ ID NO: 815562

SEQ ID NO: 815582 - protein, 726 aa, Homo sapiens; identical to SEQ ID NO: 815562

SEQ ID NO: 815583 - protein, 733 aa, Homo sapiens
MAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSPVRGRGRPSPPRAERPEREKERRVANNARERLRVRDINEAFKELGRMCQTAPQQSEKPQTKLLILHQAVLGHPELGAASASSTDEVLSLEEKDLRDRERRMANNARERVRVRDINEAFRELGRMCQMHLKSDKAQTKLLILQQAVQVILGLEQQVRERNLNPKAACLKRREEEKVSGGVFTPGAAFSKSKLIDRLNKHGIEFSVISSSEV

SEQ ID NO: 815584 - protein, 568 aa, Homo sapiens
MAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGQGISPQLGPLSTSIYLLTQDDKYWARRRKNNMAAKRSRDARRLKENQIAIRASFLEKENSALRQEVADLRKELGKCKNILAKYEARHGPL

SEQ ID NO: 815585 - protein, 171 aa, Homo sapiens
MAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSKQNLKASNKTYTLSEKKKMP

SEQ ID NO: 815586 - protein, 92 aa, Homo sapiens
EKDLRDRERRMANNARERVRVRDINEAFRELGRMCQMHLKSDKAQTKLLILQQAVQVILGLEQQVRGRLPGQGCPSTLSLPHTQVQMLGSSC

SEQ ID NO: 815587 - protein, 1097 aa, Homo sapiens
MRGMIGGGFFRGSINSQFEFGRKKENMTSPAKFKKDKEIIAEYDTQVKEIRAQLTEQMKCLDQQCELRVQLLQDLQDFFRKKAEIEMDYSRNLEKLAEHFLAKTRSTKDQQFKKDQNVLSPVNCWNLLLNQVKWESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINKQRKRPESGSIRKTFRSDSHGLSSSLTDSSSPGVGASCRPSSQPIMSQSLPKEGPDKCSISGHGSLNSISRHSSLKNRLDSPQIRKTATAGRSKSFNNHRPMDPEVIAQDIEATMNSALNELRELERQSSVKHTPDVVLDTLEPLKTSPVVAPTSEPSSPLHTQLLKDPEPAFQRSASTAGDIACAFRPVKSVKMAAPVKPPATRPKPTVFPKTNATSPGVNSSTSPQSTDKSCTV

SEQ ID NO: 815588 - protein, 485 aa, Homo sapiens
MRGMIGGGFFRGSINSQFEFGRKKENMTSPAKFKKDKEIIAEYDTQVKEIRAQLTEQMKCLDQQCELRVQLLQDLQDFFRKKAEIEMDYSRNLEKLAEHFLAKTRSTKDQQFKKDQNVLSPVNCWNLLLNQVKWESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTVRECYGF

SEQ ID NO: 815589 - protein, 473 aa, Homo sapiens
MRGMIGGGFFRGSINSQFEFGRKKENMTSPAKFKKDKEIIAEYDTQVKEIRAQLTEQMKCLDQQCELRVQLLQDLQDFFRKKAEIEMDYSRNLEKLAEHFLAKTRSTKDQQFKKDQNVLSPVNCWNLLLNQVKWESRDHTTLSDIYLNNIIPRFVQVSEDSGRLFKKSKEVGQQLQDDLMKVLNELYRISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTVRECYGF

SEQ ID NO: 815590 - protein, 286 aa, Homo sapiens
RDVCTRVCLTASHTVLSDVVKSSSLSTFIPNPMTCVTSRSIHEDTALFYFTVRKVSNIIDMRQAKYTENKLKAIKARNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTVRECYGF

SEQ ID NO: 815591 - protein, 94 aa, Homo sapiens
SIVFLEPELPEALFSSLLSLPWSCRPYIDLPLPGSKQIPLPIPFMYCLVLEEAHTSWLWVLLQHRNHEPYTLNMGSFIASNGNSGTAKGTVSSF

SEQ ID NO: 815592 - protein, 485 aa, Homo sapiens; identical to SEQ ID NO: 815588

SEQ ID NO: 815593 - protein, 836 aa, Homo sapiens
MTSPAKFKKDKEIIAEYDTQVKEIRAQLTEQMKCLDQQCELRVQLLQDLQDFFRKKAEIEMDYSRNLEKLAEHFLAKTRSTKDQQFKKDQNVLSPVNCWNLLLNQVKWESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINK

SEQ ID NO: 815594 - protein, 1341 aa, Homo sapiens
MRGMIGGGFFRGSINSQFEFGRKKENMTSPAKFKKDKEIIAEYDTQVKEIRAQLTEQMKCLDQQCELRVQLLQDLQDFFRKKAEIEMDYSRNLEKLAEHFLAKTRSTKDQQFKKDQNVLSPVNCWNLLLNQVKWESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTVDILSESAPSQPLPGSFCREILPLLIASQTWWQSVRGQDPPKFSIMTSPQDQEKMNCGGEGAFFVISSRGARRAVERPGTGLDALSGARGATTVCGGVLPRRRRLQSHHTVDCPYPAVLRTSADKPQPGLAASFSRRPPQHGLPRKQHGVEGRCLESRCPLATFPEELRSPQNSADYLFLFKRPFKGPEVSLPLLTELVQPGVAAASELCGVACMSGGHLADLTLLFCCCCFPSSLPACPFSPSEDGVVERSSPKSEIEVISEPPEEKVTARAGASCPSGGHVADIYLANINKQRKRPESGSIRKTFRSDSHGLSSSLTDSSSPGVGASCRPSSQPIMSQSLPKEGPDKCSISGHGSLNSISRHSSLKNRLDSPQIRKTATAGRSKSFNNHRPMDPEVIAQDIEATMNSALNELRELERQSSVKHTPDVVLDTLEPLKTSPVVAPTSEPSSPLHTQLLKDPEPAFQRSASTAGDIACAFRPVKSVKMAAPVKPPATRPKPTVFPKTNATSPGVNSSTSPQSTDKSCTV

SEQ ID NO: 815595 - protein, 816 aa, Homo sapiens
MRGMIGGGFFRGSINSQFEFGRKKENMTSPAKFKKDKEIIAEYDTQVKEIRAQLTEQMKCLDQQCELRVQLLQDLQDFFRKKAEIEMDYSRNLEKLAEHFLAKTRSTKDQQFKKDQNVLSPVNCWNLLLNQVKWESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTLIS

SEQ ID NO: 815596 - protein, 191 aa, Homo sapiens [sequence omitted]

SEQ ID NO: 815597 - protein, 105 aa, Homo sapiens
MVLSRGLGTDRRRVLLGRAHCKQLELRLHTVIFTPKSQKELAIQGLGRPAFLSYACRNQHDASKSPAPPLMAWILFLVWTLKGQSSGKRGGVGLLASQFRKQRSL

SEQ ID NO: 815598 - protein, 867 aa, Homo sapiens
MRGMIGGGFFRGSINSQFEFGRKKENMTSPAKFKKDKEIIAEYDTQVKEIRAQLTEQMKCLDQQCELRVQLLQDLQDFFRKKAEIEMDYSRNLEKLAEHFLAKTRSTKDQQFKKDQNVLSPVNCWNLLLNQVKWESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINNFHCGC

SEQ ID NO: 815599 - protein, 816 aa, Homo sapiens; identical to SEQ ID NO: 815595

SEQ ID NO: 815600 - protein, 371 aa, Homo sapiens
MTSPAKFKKDKEIIAEYDTQVKEIRAQLTEQMKCLDQQCELRVQLLQDLQDFFRKKAEIEMDYSRNLEKLAEHFLAKTRSTKDQQFKKDQNVLSPVNCWNLLLNQVKWESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMVRPFPYTPTLKGLEWSCLD

SEQ ID NO: 815601 - protein, 269 aa, Homo sapiens
MRGMIGGGFFRGSINSQFEFGRKKENMTSPAKFKKDKEIIAEYDTQVKEIRAQLTEQMKCLDQQCELRVQLLQDLQDFFRKKAEIEMDYSRNLEKLAEHFLAKTRSTKDQQFKKDQNVLSPVNCWNLLLNQVKWESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKMAQKRPACT

SEQ ID NO: 815602 - protein, 50 aa, Homo sapiens
MAKWGEGDPRWIVEERADATNVNNWHWTERDASNCLVRVRLRWATSVGYI

SEQ ID NO: 815603 - protein, 338 aa, Homo sapiens
MAKWGEGDPRWIVEERADATNVNNWHWTERDASNWSTDKLKTLFLAVQVQNEEGKCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVPEKHIVMKWRFKSWPEGHFATITLTFIDKNGETELCMEGRGIPAPEEERTRQGWQRYYFEGIKQTFGYGARLF

SEQ ID NO: 815604 - protein, 338 aa, Homo sapiens; identical to SEQ ID NO: 815603

SEQ ID NO: 815605 - protein, 370 aa, Homo sapiens
KGRGRKPRLGTRPGWCCGYGCSGAGGAAIGEPMAKWGEGDPRWIVEERADATNVNNWHWTERDASNWSTDKLKTLFLAVQVQNEEGKCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVPEKHIVMKWRFKSWPEGHFATITLTFIDKNGETELCMEGRGIPAPEEERTRQGWQRYYFEGIKQTFGYGARLF

SEQ ID NO: 815606 - protein, 338 aa, Homo sapiens; identical to SEQ ID NO: 815603

SEQ ID NO: 815607 - protein, 338 aa, Homo sapiens; identical to SEQ ID NO: 815603

SEQ ID NO: 815608 - protein, 338 aa, Homo sapiens; identical to SEQ ID NO: 815603

SEQ ID NO: 815609 - protein, 288 aa, Homo sapiens
MAKWGEGDPRWIVEERADATNVNNWHWTERDASNWSTDKLKTLFLAVQVQNEEGKCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVPEKHIVMKWRFKSWPEGSHCHSG

SEQ ID NO: 815610 - protein, 336 aa, Homo sapiens
ALGEVQGDVLQQSLVGPLPHGFPGCHIEVALLTKARISSMTVRVSTLSQRAGACEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVPEKHIVMKWRFKSWPEGHFATITLTFIDKNGETELCMEGRGIPAPEEERTRQGWQRYYFEGIKQTFGYGARLF

SEQ ID NO: 815611 - protein, 288 aa, Homo sapiens; identical to SEQ ID NO: 815609

SEQ ID NO: 815612 - protein, 269 aa, Homo sapiens
KARYEAWLRMAEEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVPEKHIVMKWRFKSWPEGHFATITLTFIDKNGETELCMEGRGIPAPEEERTRQGWQRYYFEGIKQTFGYGARLF

SEQ ID NO: 815613 - protein, 312 aa, Homo sapiens
MAKWGEGDPRWIVEERADATNVNNWHWTERDASNWSTDKLKTLFLAVQVQNEEGKCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVEVLVQAFTHAPATLEADRGGKFHMVDGNVSGEFTDLVPEKHIVMKWRFKSWPEGHFATITLTFIDKNGETELCMEGRGIPAPEEERTRQGWQRYYFEGIKQTFGYGARLF

SEQ ID NO: 815614 - protein, 267 aa, Homo sapiens
MAKWGEGDPRWIVEERADATNVNNWHWTERDASNWSTDKLKTLFLAVQVQNEEGKCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQERGGRGIPAPEEERTRQGWQRYYFEGIKQTFGYGARLF

SEQ ID NO: 815615 - protein, 176 aa, Homo sapiens [sequence omitted]

SEQ ID NO: 815616 - protein, 221 aa, Homo sapiens
MAKWGEGDPRWIVEERADATNVNNWHWTERDASNWSTDKLKTLFLAVQVQNEEGKCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPVLSKPGQTVEFKSHGRIFLRKLLRYNEEINE

SEQ ID NO: 815617 - protein, 113 aa, Homo sapiens
VQASLELLGSSDPPASASQSAGITGACHHAHVILVEMEFHHVSQAGLELLTSGDPPTSACQSAGITGVSHHAQPGCPSLKLRWKPRYETSVPSAFPRTLCHHHLDLHRQERRD

SEQ ID NO: 815618 - protein, 157 aa, Homo sapiens
MAKWGEGDPRWIVEERADATNVNNWHWTERDASNWSTDKLKTLFLAVQVQNEEGKCEVTEVSKLDGEASINNRKGKLIFFYEWSVKLNWTGTSKSGVQYKGHVEIPNLSDENSVDEVELWRTLILGPAAGDSSLLDTSVQLSPDWGLRLTGLHRPSC

SEQ ID NO: 815619 - protein, 45 aa, Homo sapiens
MRVPLKLFTTYFSSFTQISVSLAKDEPDTNLVALMKEEGVKLLRE

SEQ ID NO: 815620 - protein, 825 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 815621 - protein, 73 aa, Homo sapiens
RVDDEWSHHCSTELRCCTSWFFCSPSALASPNGVALLWAPVPCELPGPAAGGKLWTLQDAVWRKEEGGSQEVW

SEQ ID NO: 815622 - protein, 661 aa, Homo sapiens
MLPFLYQFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 815623 - protein, 861 aa, Homo sapiens
PARRGPGKGHPGVPHFPLGRPDGEWSRGAQVPWHLPMGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 815624 - protein, 732 aa, Homo sapiens
MPISQHFGRPSPADHRRSGVRDQPGQHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 815625 - protein, 810 aa, Homo sapiens
MQKDARREGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 815626 - protein, 732 aa, Homo sapiens
MPIIPALWEAEPADHRRSGVRDQPGQHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 815627 - protein, 661 aa, Homo sapiens; identical to SEQ ID NO: 815622

SEQ ID NO: 815628 - protein, 739 aa, Homo sapiens
MAGCGGSCLLSQHFGRPSPADHRRSGVRDQPGQHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 815629 - protein, 294 aa, Homo sapiens
MLPFLYQFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRAGHQASAWKVWPKGSLAAALLLLLMDEFGDGAGDAAYQGPVLIEADAPIMIGIQVLDELIRSLQIK

SEQ ID NO: 815630 - protein, 317 aa, Homo sapiens
PARRGPGKGHPGVPHFPLGRPDGEWSRGAQVPWHLPMGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIETEWRDQIPYAPPQPPRSRIIIR

SEQ ID NO: 815631 - protein, 265 aa, Homo sapiens
PARRGPGKGHPGVPHFPLGRPDGEWSRGAQVPWHLPMGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNCEYQEA

SEQ ID NO: 815632 - protein, 131 aa, Homo sapiens [sequence omitted]

SEQ ID NO: 815633 - protein, 103 aa, Homo sapiens
MGWLCSGLLFPVSCLVLLQVASSGNMKVLQEPTCVSDYMSISTCEWKMNGPTNCSTELRCMAGGSSYAWNPQNKYAQPPCGPGNPDSRHKAPVTLHVGPDLRC

SEQ ID NO: 815634 - protein, 141 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHGEQGGVRQGWLGVFPQLPGLR

SEQ ID NO: 815635 - protein, 307 aa, Homo sapiens
ECTWHQHGGGGGGFQQALGRRADRNAARGLRGGVWVLRGDWSHGGVGACSGKEAPARWLEGALGMAESPAGGGASRFGRRRGLGFPGLPLARVNADPPLRDPSALPFFPSASFCSGVGASAPCALAQKLLCRLLQHRRKRRSTPLTSSTLPSQATEKSSYFQTTEISLWTVVAAIQAVEKKMESQAARLQSLEGRTGTAEKKLADCEKMAVEFGNQLEGKWAVLGTLLQEYGLLQRRLENVENLLRNRNFWILRLPPGSKGEAPKVSSVIGEIDGGLFPRSRTGRILDGMAEWNLNRHVDGQYTMRT

SEQ ID NO: 815636 - protein, 495 aa, Homo sapiens
MAESAPARHRRKRRSTPLTSSTLPSQATEKSSYFQTTEISLWTVVAAIQAVEKKMESQAARLQSLEGRTGTAEKKLADCEKMAVEFGNQLEGKWAVLGTLLQEYGLLQRRLENVENLLRNRNFWILRLPPGSKGEAPKVSRSLENDGVCFTEQEWENLEDWQKELYRNVMESNYETLVSLKVLGQTEGEAELGTEMLGDLEEEGPGGAHPAGGVMIKQELQYTQEGPADLPGEFSCIAEEQAFLSPEQTELWGGQGSSVLLETGPGDSTLEEPVGSRVPSSSRTVGCPKQKSHRQVQLDQECGQGLKLKKDTSRPYECSECEITFRYKQQLATHLRSHSGWGSCTPEEPEESLRPRPRLKPQTKKAKLHQCDVCLRSFSCKVSLVTHQRCHLQEGPSAGQHVQERFSPNSLVALPGHIPWRKSRSSLICGYCGKSFSHPSDLVRHQRIHTGERPYSCTECEKSFVQKQHLLQHQKIHQRERGGLALEPGRPNGLL

SEQ ID NO: 815637 - protein, 441 aa, Homo sapiens
MESQAARLQSLEGRTGTAEKKLADCEKMAVEFGNQLEGKWAVLGTLLQEYGLLQRRLENVENLLRNRNFWILRLPPGSKGEAPKVSRSLENDGVCFTEQEWENLEDWQKELYRNVMESNYETLVSLKVLGQTEGEAELGTEMLGDLEEEGPGGAHPAGGVMIKQELQYTQEGPADLPGEFSCIAEEQAFLSPEQTELWGGQGSSVLLETGPGDSTLEEPVGSRVPSSSRTVGCPKQKSHRQVQLDQECGQGLKLKKDTSRPYECSECEITFRYKQQLATHLRSHSGWGSCTPEEPEESLRPRPRLKPQTKKAKLHQCDVCLRSFSCKVSLVTHQRCHLQEGPSAGQHVQERFSPNSLVALPGHIPWRKSRSSLICGYCGKSFSHPSDLVRHQRIHTGERPYSCTECEKSFVQKQHLLQHQKIHQRERGGLALEPGRPNGLL

SEQ ID NO: 815638 - protein, 441 aa, Homo sapiens; identical to SEQ ID NO: 815637

SEQ ID NO: 815639 - protein, 346 aa, Homo sapiens
MEAELEDERKQRSMAVAARKKLEMDLKDLEAQVLGQTEGEAELGTEMLGDLEEEGPGGAHPAGGVMIKQELQYTQEGPADLPGEFSCIAEEQAFLSPEQTELWGGQGSSVLLETGPGDSTLEEPVGSRVPSSSRTVGCPKQKSHRQVQLDQECGQGLKLKKDTSRPYECSECEITFRYKQQLATHLRSHSGWGSCTPEEPEESLRPRPRLKPQTKKAKLHQCDVCLRSFSCKVSLVTHQRCHLQEGPSAGQHVQERFSPNSLVALPGHIPWRKSRSSLICGYCGKSFSHPSDLVRHQRIHTGERPYSCTECEKSFVQKQHLLQHQKIHQRERGGLALEPGRPNGLL

SEQ ID NO: 815640 - protein, 495 aa, Homo sapiens; identical to SEQ ID NO: 815636

SEQ ID NO: 815641 - protein, 213 aa, Homo sapiens
MIKQELQYTQEGPADLPGEFSCIAEEQAFLSPEQTELWGGQGSSVLLETGPGDSTLEEPVGSRVPSSSRTVGCPKQKSHRQVQLDQECGQGLKLKKDTSRPYECSECEITFRYKQQLATHLRSHSGWGSCTPEEPEESLRPRPRLKPQTKKAKLHQCDVCLRSFSCKVSLVTHQRCHLQEGPSAGQHVQERFSPNSLVALPGHIPWRKSRSSL

SEQ ID NO: 815642 - protein, 2663 aa, Homo sapiens
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKFPDREFLLRVSYMEIYNETITDLLCGTQKMKPLIIREDVNRNVYVADLTEEVVYTSEMALKWITKGEKSRHYGETKMNQRSSRSHTIFRMILESREKGEPSNCEGSVKVSHLNLVDLAGSERAAQTGAAGVRLKEGCNINRSLFILGQVIKKLSDGQVGGFINYRDSKLTRILQNSLGGNAKTRIICTITPVSFDETLTALQFASTAKYMKNTPYVNEVSTDEALLKRYRKEIMDLKKQLEEVSLETRAQAMEKDQLAQLLEEKDLLQKVQNEKIENLTRMLVTSSSLTLQQELKAKRKRRVTWCLGKINKMKNSNYADQFNIPTNITTKTHKLSINLLREIDESVCSESDVFSNTLDTLSEIEWNPATKLLNQENIESELNSLRADYDNLVLDYEQLRTEKEEMELKLKEKNDLDEFEALERKTKKDQEMQLIHEISNLKNLVKHREVYNQDLENELSSKVELLREKEDQIKKLQEYIDSQKLENIKMDLSYSLESIEDPKQMKQTLFDAETVALDAKRESAFLRSENLELKEKMKELATTYKQMENDIQLYQSQLEAKKKMQVDLEKELQSAFNEITKLTSLIDGKVPKDLLCNLELEGKITDLQKELNKEVEENEALREEVILLSELKSLPSEVERLRKEIQDKSEELHIITSEKDKLFSEVVHKESRVQGLLEEIGKTKDDLATTQSNYKSTDQEFQNFKTLHMDFEQKYKMVLEENERMNQEIVNLSKEAQKFDSSLGALKTELSYKTQELQEKTREVQERLNEMEQLKEQLENRDSPLQTVEREKTLITEKLQQTLEEVKTLTQEKDDLKQLQESLQIERDQLKSDIHDTVNMNIDTQEQLRNALESLKQHQETINTLKSKISEEVSRNLHMEENTGETKDEFQQKMVGIDKKQDLEAKNTQTLTADVKDNEIIEQQRKIFSLIQEKNELQQMLESVIAEKEQLKTDLKENIEMTIENQEELRLLGDELKKQQEIVAQEKNHAIKKEGELSRTCDRLAEVEEKLKEKSQQLQEKQQQLLNVQEEMSEMQKKINEIENLKNELKNKELTLEHMETERLELAQKLNENYEEVKSITKERKVLKELQKSFETERDHLRGYIREIEATGLQTKEELKIAHIHLKEHQETIDELRRSVSEKTAQIINTQDLEKSHTKLQEEIPVLHEEQELLPNVKKVSETQETMNELELLTEQSTTKDSTTLARIEMERLRLNEKFQESQEEIKSLTKERDNLKTIKEALEVKHDQLKEHIRETLAKIQESQSKQEQSLNMKEKDNETTKIVSEMEQFKPKDSALLRIEIEMLGLSKRLQESHDEMKSVAKEKDDLQRLQEVLQSESDQLKENIKEIVAKHLETEEELKVAHCCLKEQEETINELRVNLSEKETEISTIQKQLEAINDKLQNKIQEIYEKEEQFNIKQISEVQEKVNELKQFKEHRKAKDSALQSIESKMLELTNRLQESQEEIQIMIKEKEEMKRVQEALQIERDQLKENTKEIVAKMKESQEKEYQFLKMTAVNETQEKMCEIEHLKEQFETQKLNLENIETENIRLTQILHENLEEMRSVTKERDDLRSVEETLKVERDQLKENLRETITRDLEKQEELKIVHMHLKEHQETIDKLRGIVSEKTNEISNMQKDLEHSNDALKAQDLKIQEELRIAHMHLKEQQETIDKLRGIVSEKTDKLSNMQKDLENSNAKLQEKIQELKANEHQLITLKKDVNETQKKVSEMEQLKKQIKDQSLTLSKLEIENLNLAQKLHENLEEMKSVMKERDNLRRVEETLKLERDQLKESLQETKARDLEIQQELKTARMLSKEHKETVDKLREKISEKTIQISDIQKDLDKSKDELQKKIQELQKKELQLLRVKEDVNMSHKKINEMEQLKKQFEPNYLCKCEMDNFQLTKKLHESLEEIRIVAKERDELRRIKESLKMERDQFIATLREMIARDRQNHQVKPEKRLLSDGQQHLMESLREKCSRIKELLKRYSEMDDHYECLNRLSLDLEKEIEFQKELSRDKYVLSYVTKIKEEQHESINKFEMDFIDEVEKQKELLIKIQHLQQDCDVPSRELRDLKLNQNMDLHIEEILKDFSESEFPSIKTEFQQVLSNRKEMTQFLEEWLNTRFDIEKLKNGIQKENDRICQVNNFFNNRIIAIMNESTEFEERSATISKEWEQDLKSLKEKNEKLFKNYQTLKTSLASGAQVNPTTQDNKNPHVTSRATQLTTEKIRELENSLHEAKESAMHKESKIIKMQKELEVTNDIIAKLQAKVHESNKCLEKTKETIQVLQDKVALGAKPYKEEIEDLKMKLVKIDLEKMKNAKEFEKEISATKATVEYQKEVIRLLRENLRRSQQAQDTSVISEHTDPQPSNKPLTCGGGSGIVQNTKALILKSEHIRLEKEISKLKQQNEQLIKQKNELLSNNQHLSNEVKTWKERTLKREAHKQVTCENSPKSPKVTGTASKKKQITPSQCKERNLQDPVPKESPKSCFFDSRSKSLPSPHPVRYFDNSSLGLCPEVQNAGAESVDSQPGPWHASSGKDVPECKTQ

SEQ ID NO: 815643 - protein, 2663 aa, Homo sapiens; identical to SEQ ID NO: 815642

SEQ ID NO: 815644 - protein, 2562 aa, Homo sapiens
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKFPDREFLLRVSYMEIYNETITDLLCGTQKMKPLIIREDVNRNVYVADLTEEVVYTSEMALKWITKGEKSRHYGETKMNQRSSRSHTIFRMILESREKGEPSNCEGSVKVSHLNLVDLAGSERAAQTGAAGVRLKEGCNINRSLFILGQVIKKLSDGQVGGFINYRDSKLTRILQNSLGGNAKTRIICTITPVSFDETLTALQFASTAKYMKNTPYVNEVSTDEALLKRYRKEIMDLKKQLEEVSLETRAQAMEKDQLAQLLEEKDLLQKVQNEKIENLTRMLVTSSSLTLQQELKAKRKRRVTWCLGKINKMKNSNYADQFNIPTNITTKTHKLSINLLREIDESVCSESDVFSNTLDTLSEIEWNPATKLLNQENIESELNSLRADYDNLVLDYEQLRTEKEEMELKLKEKNDLDEFEALERKTKKDQENELSSKVELLREKEDQIKKLQEYIDSQKLENIKMDLSYSLESIEDPKQMKQTLFDAETVALDAKRESAFLRSENLELKEKMKELATTYKQMENDIQLYQSQLEAKKKMQVDLEKELQSAFNEITKLTSLIDGKVPKDLLCNLELEGKITDLQKELNKEVEENEALREEVILLSELKSLPSEVERLRKEIQDKSEELHIITSEKDKLFSEVVHKESRVQGLLEEIGKTKDDLATTQSNYKSTDQEFQNFKTLHMDFEQKYKMVLEENERMNQEIVNLSKEAQKFDSSLGALKTELSYKTQELQEKTREVQERLNEMEQLKEQLENRDSPLQTVEREKTLITEKLQQTLEEVKTLTQEKDDLKQLQESLQIERDQLKSDIHDTVNMNIDTQEQLRNALESLKQHQETINTLKSKISEEVSRNLHMEENTGETKDEFQQKMVGIDKKQDLEAKNTQTLTADVKDNEIIEQQRKIFSLIQEKNELQQMLESVIAEKEQLKTDLKENIEMTIENQEELRLLGDELKKQQEIVAQEKNHAIKKEGELSRTCDRLAEVEEKLKEKSQQLQEKQQQLLNVQEEMSEMQKKINEIENLKNELKNKELTLEHMETERLELAQKLNENYEEVKSITKERKVLKELQKSFETERDHLRGYIREIEATGLQTKEELKIAHIHLKEHQETIDELRRSVSEKTAQIINTQDLEKSHTKLQEEIPVLHEEQELLPNVKKVSETQETMNELELLTEQSTTKDSTTLARIEMERLRLNEKFQESQEEIKSLTKERDNLKTIKEALEVKHDQLKEHIRETLAKIQESQSKQEQSLNMKEKDNETTKIVSEMEQFKPKDSALLRIEIEMLGLSKRLQESHDEMKSVAKEKDDLQRLQEVLQSESDQLKENIKEIVAKHLETEEELKVAHCCLKEQEETINELRVNLSEKETEISTIQKQLEAINDKLQNKIQEIYEKEEQFNIKQISEVQEKVNELKQFKEHRKAKDSALQSIESKMLELTNRLQESQEEIQIMIKEKEEMKRVQEALQIERDQLKENTKEIVAKMKESQEKEYQFLKMTAVNETQEKMCEIEHLKEQFETQKLNLENIETENIRLTQILHENLEEMRSVTKERDDLRSVEETLKVERDQLKENLRETITRDLEKQEELKIVHMHLKEHQETIDKLRGIVSEKTNEISNMQKDLEHSNDALKAQDLKIQEELRIAHMHLKEQQETIDKLRGIVSEKTDKLSNMQKDLENSNAKLQEKIQELKANEHQLITLKKDVNETQKKVSEMEQLKKQIKDQSLTLSKLEIENLNLAQKLHENLEEMKSVMKERDNLRRVEETLKLERDQLKESLQETKARDLEIQQELKTARMLSKEHKETVDKLREKISEKTIQISDIQKDLDKSKDELQKKDRQNHQVKPEKRLLSDGQQHLMESLREKCSRIKELLKRYSEMDDHYECLNRLSLDLEKEIEFQKELSMKVKANLSLPYLQTKHIEKLFTANQRCSMEFHRIMKKLKKYVLSYVTKIMEKQKELLIKIQHLQQDCDVPSRELRDLKLNQNMDLHIEEILKDFSESEFPSIKTEFQQVLSNRKEMTQFLEEWLNTRFDIEKLKNGIQKENDRICQVNNFFNNRIIAIMNESTEFEERSATISKEWEQDLKSLKEKNEKLFKNYQTLKTSLASGAQVNPTTQDNKNPHVTSRATQLTTEKIRELENSLHEAKESAMHKESKIIKMQKELEVTNDIIAKLQAKVHESNKCLEKTKETIQVLQDKVALGAKPYKEEIEDLKMKLVKIDLEKMKNAKEFEKEISATKATVEYQKEVIRLLRENLRRSQQAQDTSVISEHTDPQPSNKPLTCGGGSGIVQNTKALILKSEHIRLEKEISKLKQQNEQLIKQKNELLSNNQHLSNEVKTWKERTLKREAHKQVTCENSPKSPKVTGTASKKKQITPSQCKERNLQDPVPKESPKSCFFDSRSKSLPSPHPVRYFDNSSLGLCPEVQNAGAESVDSQPGPWHASSGKDVPECKTQ

SEQ ID NO: 815645 - protein, 1149 aa, Homo sapiens
IIINPKYLERGVNYNKIDYNVSINLLEFPLIIKHLETEEELKVAHCCLKEQEETINELRVNLSEKETEISTIQKQLEAINDKLQNKIQEIYEKEEQFNIKQISEVQEKVNELKQFKEHRKAKDSALQSIESKMLELTNRLQESQEEIQIMIKEKEEMKRVQEALQIERDQLKENTKEIVAKMKESQEKEYQFLKMTAVNETQEKMCEIEHLKEQFETQKLNLENIETENIRLTQILHENLEEMRSVTKERDDLRSVEETLKVERDQLKENLRETITRDLEKQEELKIVHMHLKEHQETIDKLRGIVSEKTNEISNMQKDLEHSNDALKAQDLKIQEELRIAHMHLKEQQETIDKLRGIVSEKTDKLSNMQKDLENSNAKLQEKIQELKANEHQLITLKKDVNETQKKVSEMEQLKKQIKDQSLTLSKLEIENLNLAQKLHENLEEMKSVMKERDNLRRVEETLKLERDQLKESLQETKARDLEIQQELKTARMLSKEHKETVDKLREKISEKTIQISDIQKDLDKSKDELQKKDRQNHQVKPEKRLLSDGQQHLMESLREKCSRIKELLKRYSEMDDHYECLNRLSLDLEKEIEFQKELSMKVKANLSLPYLQTKHIEKLFTANQRCSMEFHRIMKKLKQYVLSYVTKIMEKQKELLIKIQHLQQDCDVPSRELRDLKLNQNMDLHIEEILKDFSESEFPSIKTEFQQVLSNRKEMTQFLEEWLNTRFDIEKLKNGIQKENDRICQVNNFFNNRIIAIMNESTEFEERSATISKEWEQDLKSLKEKNEKLFKNYQTLKTSLASGAQVNPTTQDNKNPHVTSRATQLTTEKIRELENSLHEAKESAMHKESKIIKMQKELEVTNDIIAKLQAKVHESNKCLEKTKETIQVLQDKVALGAKPYKEEIEDLKMKLVKIDLEKMKNAKEFEKEISATKATVEYQKEVIRLLRENLRRSQQAQDTSVISEHTDPQPSNKPLTCGGGSGIVQNTKALILKSEHIRLEKEISKLKQQNEQLIKQKNELLSNNQHLSNEVKTWKERTLKREAHKQVTCENSPKSPKVTGTASKKKQITPSQCKERNLQDPVPKESPKSCFFDSRSKSLPSPHPVRYFDNSSLGLCPEVQNAGAESVDSQPGPWHASSGKDVPECKTQ

SEQ ID NO: 815646 - protein, 2348 aa, Homo sapiens
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKFPDREFLLRVSYMEIYNETITDLLCGTQKMKPLIIREDVNRNVYVADLTEEVVYTSEMALKWITKGEKSRHYGETKMNQRSSRSHTIFRMILESREKGEPSNCEGSVKVSHLNLVDLAGSERAAQTGAAGVRLKEGCNINRSLFILGQVIKKLSDGQVGGFINYRDSKLTRILQNSLGGNAKTRIICTITPVSFDETLTALQFASTAKYMKNTPYVNEVSTDEALLKRYRKEIMDLKKQLEEVSLETRAQAMEKDQLAQLLEEKDLLQKVQNEKIENLTRMLVTSSSLTLQQELKAKRKRRVTWCLGKINKMKNSNYADQFNIPTNITTKTHKLSINLLREIDESVCSESDVFSNTLDTLSEIEWNPATKLLNQENIESELNSLRADYDNLVLDYEQLRTEKEEMELKLKEKNDLDEFEALERKTKKDQENELSSKVELLREKEDQIKKLQEYIDSQKLENIKMDLSYSLESIEDPKQMKQTLFDAETVALDAKRESAFLRSENLELKEKMKELATTYKQMENDIQLYQSQLEAKKKMQVDLEKELQSAFNEITKLTSLIDGKVPKDLLCNLELEGKITDLQKELNKEVEENEALREEVILLSELKSLPSEVERLRKEIQDKSEELHIITSEKDKLFSEVVHKESRVQGLLEEIGKTKDDLATTQSNYKSTDQEFQNFKTLHMDFEQKYKMVLEENERMNQEIVNLSKEAQKFDSSLGALKTELSYKTQELQEKTREVQERLNEMEQLKEQLENRDSPLQTVEREKTLITEKLQQTLEEVKTLTQEKDDLKQLQESLQIERDQLKSDIHDTVNMNIDTQEQLRNALESLKQHQETINTLKSKISEEVSRNLHMEENTGETKDEFQQKMVGIDKKQDLEAKNTQTLTADVKDNEIIEQQRKIFSLIQEKNELQQMLESVIAEKEQLKTDLKENIEMTIENQEELRLLGDELKKQQEIVAQEKNHAIKKEGELSRTCDRLAEVEEKLKEKSQQLQEKQQQLLNVQEEMSEMQKKINEIENLKNELKNKELTLEHMETERLELAQKLNENYEEVKSITKERKVLKELQKSFETERDHLRGYIREIEATGLQTKEELKIAHIHLKEHQETIDELRRSVSEKTAQIINTQDLEKSHTKLQEEIPVLHEEQELLPNVKKVSETQETMNELELLTEQSTTKDSTTLARIEMERLRLNEKFQESQEEIKSLTKERDNLKTIKEALEVKHDQLKEHIRETLAKIQESQSKQEQSLNMKEKDNETTKIVSEMEQFKPKDSALLRIEIEMLGLSKRLQESHDEMKSVAKEKDDLQRLQEVLQSESDQLKENIKEIVAKHLETEEELKVAHCCLKEQEETINELRVNLSEKETEISTIQKQLEAINDKLQNKIQEIYEKEEQFNIKQISEVQEKVNELKQFKEHRKAKDSALQSIESKMLELTNRLQESQEEIQIMIKEKEEMKRVQEALQIERDQLKENTKEIVAKMKESQEKEYQFLKMTAVNETQEKMCEIEHLKEQFETQKLNLENIETENIRLTQILHENLEEMRSVTKERDDLRSVEETLKVERDQLKENLRETITRDLEKQEELKIVHMHLKEHQETIDKLRGIVSEKTNEISNMQKDLEHSNDALKAQDLKIQEELRIAHMHLKEQQETIDKLRGIVSEKTDKLSNMQKDLENSNAKLQEKIQELKANEHQLITLKKDVNETQKKVSEMEQLKKQIKDQSLTLSKLEIENLNLAQKLHENLEEMKSVMKERDNLRRVEETLKLERDQLKESLQETKARDLEIQQELKTARMLSKEHKETVDKLREKISEKTIQISDIQKDLDKSKDELQKKDRQNHQVKPEKRLLSDGQQHLMESLREKCSRIKELLKRYSEMDDHYECLNRLSLDLEKEIEFQKELSMKVKANLSLPYLQTKHIEKLFTANQRCSMEFHRIMKKLKKYVLSYVTKIMEKQKELLIKIQHLQQDCDVPSRELRDLKLNQNMDLHIEEILKDFSESEFPSIKTEFQQVLSNRKEMTQFLEEWLNTRFDIEKLKNGIQKENDRICQVNNFFNNRIIAIMNESTEFEERSATISKEWEQDLKSLKEKNEKLFKNYQTLKTSLASGAQVNPTTQDNKNPHVTSRATQLTTEKIRELENSLHEAKESAMHKESKIIKMQKELEVTNDIIAKLQAKVHESNKCLEKTKETIQVLQDKVALGAKPYKEEIEDLKMKLVKIDLEKMKNAKEFEKEYVFVLI

SEQ ID NO: 815647 - protein, 320 aa, Homo sapiens
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWVSLNAWFWSTVFHTRDTDLTEKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 815648 - protein, 192 aa, Homo sapiens
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWVSLNAWFWSTVFHTRDTDLTEKIYYFFSSTFILHSIYLFFFITFLHHP

SEQ ID NO: 815649 - protein, 154 aa, Homo sapiens
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWMRKLRHSKAK

SEQ ID NO: 815650 - protein, 93 aa, Homo sapiens
LWSASSAQDATWADSQELSMARLPHVRKCVVVVLLLQGLSLLELLDFPPLFWVLDAHAIWHISTIPVHVLFFSFLEDDSLYLLKESEDKFKRG

SEQ ID NO: 815651 - protein, 233 aa, Homo sapiens
AASQGERMAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWVSLNAWFWSTVFHTRDTDLTEKMDYFCASTVILHSIYLCCVRPGQRGVVAGLVPVEPAAAASRAQVRGGGLAAAGAVPARAA

SEQ ID NO: 815652 - protein, 206 aa, Homo sapiens
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWVSLNAWFWSTVFHTRDTDLTEKMDYFCASTVILHSIYLCCVSFLEDDSLYLLKESEDKFKLD

SEQ ID NO: 815653 - protein, 165 aa, Homo sapiens
MHQCWGEEMLQGMLLWGWATCPLSNPGRWGRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 815654 - protein, 154 aa, Homo sapiens; identical to SEQ ID NO: 815649

SEQ ID NO: 815655 - protein, 117 aa, Homo sapiens
MRASSFLIVVVFLIAGTLVLEAAVTGVPVKGQDTVKGRVPFNGQDPVKGQVSVKGQDKVKAQEPVKGPVSTKPGSCPIILIRCAMLNPPNRCLKDTDCPGIKKCCEGSCGMACFVPQ

SEQ ID NO: 815656 - protein, 114 aa, Homo sapiens
FPVRKLEDPLIAGMLVLEAAVTGVPVKGQDTVKGRVPFNGQDPVKGQVSVKGQDKVKAQEPVKGPVSTKPGSCPIILIRCAMLNPPNRCLKDTDCPGIKKCCEGSCGMACFVPQ

SEQ ID NO: 815657 - protein, 117 aa, Homo sapiens; identical to SEQ ID NO: 815655

SEQ ID NO: 815658 - protein, 98 aa, Homo sapiens
GSFLLLTVPVKGQDTVKGRVPFNGQDPVKGQVSVKGQDKVKAQEPVKGPVSTKPGSCPIILIRCAMLNPPNRCLKDTDCPGIKKCCEGSCGMACFVPQ

SEQ ID NO: 815659 - protein, 117 aa, Homo sapiens; identical to SEQ ID NO: 815655

SEQ ID NO: 815660 - protein, 117 aa, Homo sapiens; identical to SEQ ID NO: 815655

SEQ ID NO: 815661 - protein, 67 aa, Homo sapiens
MDTGNSWPKKPWLDRGAFPPKKPRRPAFDKPDGVGQPGSHGARRTPARCGRKRRSGEQRHNRHDRHE

SEQ ID NO: 815662 - protein, 122 aa, Homo sapiens
MEEDQELERKAIEELLKEAKRGKTRAETMGPMGWMKCPLASTNKRFLINTIKNTLPSHKEQDHEQKEGDKEPAKSQAQKEENPKKHRSHPYKHSFRARGSASYSPPRKRSSQDKYEKRSNRR

SEQ ID NO: 815663 - protein, 133 aa, Homo sapiens
MEEDQELERKISGLKTSMAEGERKTALEMVQAAGTDRHCVTFVLHEEDHTLGNSLRYMIMKNPEVEFCGYTTTHPSESKINLRIQTRGTLPAVEPFQRGLNELMNVCQHVLDKFEASIKDYKDQKASRNESTF

SEQ ID NO: 815664 - protein, 133 aa, Homo sapiens; identical to SEQ ID NO: 815663

SEQ ID NO: 815665 - protein, 151 aa, Homo sapiens
PLAPGCPRRPPDSPAEAPLARCLRAPPAAAKSGTAGEGVNIQRNRGAGWGEARRTGGAGKQKRSCAGQLESGRVGASGEGTRRADSRGSAPEGAQRRPGRRELDGERAWAAKGCRGGGWAPGNKVENATASSPVKQIPPSTFVFCGDSSRT

SEQ ID NO: 815666 - protein, 151 aa, Homo sapiens; identical to SEQ ID NO: 815665

SEQ ID NO: 815667 - protein, 133 aa, Homo sapiens; identical to SEQ ID NO: 815663

SEQ ID NO: 815668 - protein, 122 aa, Homo sapiens; identical to SEQ ID NO: 815662

SEQ ID NO: 815669 - protein, 115 aa, Homo sapiens
MEEDQELERKISGLKTSMAEGERKTALEMVQAAGTDRHCVTFVLHEEDHTLGNSLRYMIMKNPEVEFCGYTTTHPSESQRGLNELMNVCQHVLDKFEASIKDYKDQKASRNESTF

SEQ ID NO: 815670 - protein, 3052 aa, Homo sapiens
MDLFDFFRDWDLEQQCHYEQDRSALKKREWERRNQEVQQEDDLFSSGFDLFGEPYKTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILREMTHSWPTPLTSMHTAGHSEQSTFSIPGQESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLVGCASMPTCCSGCSQISSIIDPSLYLYQRTDGHWWNSTHWGTFSLVMFVFMLLLLSVKNRSHCKLTLQLKGSVRIYYLVIFFLLAFDMHFSDSTIFLCFMDDSPYNIVLSPHYPKQRMGSTCDKDRLLEMQQVVLHIHENLDTRDHPPNSTLIPRKEHISESVKLLCIPQIQSSGENFHCQNPLVRCCSNIIKSRVSRKEMSIAMLLLKRCYATQPEDFLVSIPFLIPYFVNFNDKKKEVTFILTSFRHQLASVFFNSIISSVNPHLGFSVCKAVLLKNSLVDACLSSQNAYTLDLQVGVKRGLESVQQGIHTSASFATTTFTQLVSGSITGRIFKLYFAQIYGNKSQGIIYLEVMIYSFLPSGLKIWTSSIIIHIFSLIGFLFSTFFFLLSVFPFPLFGSLTFDWITITPFIKVHIIVNHFHENFYENSKLSEIVANFYFFKMSRGECFTLRCFERALNIGNHSPNLETFLTGCDYPTYDPSHSFYVPKHHNVNIIFDVPAHQKILTLGVNTIHALLTGNYLLVYNSMEPLICWVIKFCSLSYDQINNRYAHEKMQTCVIIKASHAVSMIETAGDDSALSLSRLAISPVAKQPDLSCALVIFEFKAFCCIRLWKLYSNGCSHVVNMADGSIPAAEPSTFYAPTVVELYVYSLSNNTYASKHSQMNLKESFLSLLKEENDDNIKDSEHPRLVSHIKIKLMTLQCLKLSLYHGLPGRVPGYYYIMKPTGLTCKFNLNHNPDHHGFRSRFFLKSHIQKLDIRMLGSFPEKQAYCLMDERLVVLVSVTCYIYLHTTGRQEDSLSSLVTECKICAKFCSTVTKSDNLSSGSPLDYVVDSFIKQLRNKLNMEDELPSYPLDKTSFSFMIKDCCCFIVTLFITVYMVMRVVGVQLFEGLRDGDILSNESLQYTSLWEGYETCGWQGEIVPLDLDGGFGETHLNKHVEVRIEGREKEAPSEQVHQMISALQLDPGRATTTPSLVTQAPTTESLTSLCYDVGFGFVFLINFGFLVVLSYNCLSLVGRITLKRVYYVVLRVEFSCKHVVSQPVDCELLNNLIGKILVVLYLDDIIGKSRLAATTFKRLKVGMPFFPCKEMKRPKSSGKKQVAKLETIGKKCVLLSFQMDEFSFGHYITKFIRFCLHWKDTLLAYLSQRYLIWILFHANLHPGGGSWSLRLENIFEGRISGVVRVKPHILLNRHDKIHLHELAGGRTKLDHWVRLLSKAMNCLLREASLSPLRKMCGKMNSYTVSNEWVNSAPPNLILWGKIIEPVVSVLLHDWQTKFFIVVVIVVVVSHFHSHGLILIIKIYIHFLFSVSRLQQQKWHLCIHNQHLPWQETNQIGRSQTLILPSDIFGEGKSINSLSILLLRNIEALFTKIITFYSVIYQLKENCMKPHKARLQFLPLFASDMRCERIIHSAHIGLGDTELLFRSMISHHSSKRLELCCFINCAVRLMVFNKNHSKFQTLLPVTSILLALDLYQTLRREGGSEGSLRPGPWQDAAVASSSSPACQQLLVSSSMQTSCGKPPEEVPQLMLSAGNSLFLLGNSLFSSLCSRKPAVIFGGNFRCFTFLVLSCITHVATKVSLRIEPNVVTMGVKCTPDAQALLWFCSVYEIGRKETLDSKQNWRHSNEAKLMPCCPEQDLASHLVSLACNQWCAGKMFNNQLLRIESTWFAPFANFHGINTTTLDDFKLPTVMSLNTWLERDARSWLLQAWAKMLQHATGCSQSEGSYLIYVFMWTHTDTHTQTHPYTHTSMTKTIT

SEQ ID NO: 815671 - protein, 427 aa, Homo sapiens
MDLFDFFRDWDLEQQCHYEQDRSALKKREWERRNQEVQQEDDLFSSGFDLFGEPYKTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKMLEDDLKLSSDEDDLEPVKTLTTQCTATELYQAVEKAKPRNNPVK

SEQ ID NO: 815672 - protein, 703 aa, Homo sapiens
MINKNEMCPDLKHAPWKGMLYYEIVIIYTALLHGSINISLLNSFVQLYNFVEQCFDLGYIILEQVEWLQADETVLYQDFSINFVGGLAITNIFRCFCNHYKYEKNLFKKFPIVLQSRLFRFIFFFSFLLFLFHYFSMGGLLSLTEENFDCNGLSLSPPLSLSPLFFPPSLCPSPLIKILKSGVFDEICIRPGYMLGMKSGQISMGFQRMLHVHWALSHPTVINEKDRGSFFKKSTLIISSETYMQFNKLTPPIFPVGKLTETCKIPLRVVRGVFCLVYSVCVCFVSNRHIHVIVYSYEVFPNIPISLYIRIRKIIPTCCKRRCDSITFLFFLEKKGHFHAYFKQKFCIFKCHRKYLLSNWDTNGNLIVIICFVCGDAYQHHVAGPLWQAITAQRVHIVSVCVCVCVRARTCVCVSLHVQTCLACCPSWDFSFPFLKNIILQFQEALVTLLYEGSDFEMKIPFLLEALVIISWFNETDSTGLCDEKGSVKIQLSFQEEIVVGQDAMRGKMEATSAGEHELSEPSVLKLTCSKLQSKTLGPVPGLCSLPSKKRSRTIRNSLPGSYEENFLTSCPQRKTLSPRAPQVAIKIVMIIQKVPPWLYENPISLLNHLFLGADFQHSCSLQIHQLSLFLTSMLVLSEFQKFQFPVQTRVNCSKINQLMKCYLVFKSWFHVLYVYKTISACVALHFKCVAHKRFVGALFSVQ

SEQ ID NO: 815673 - protein, 3023 aa, Homo sapiens
MDLFDFFRDWDLEQQCHYEQDRSALKKREWERRNQEVQQEDDLFSSGFDLFGEPYKTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLVGCASMPTCCSGCSQISSIIDPSLYLYQRTDGHWWNSTHWGTFSLVMFVFMLLLLSVKNRSHCKLTLQLKGSVRIYYLVIFFLLAFDMHFSDSTIFLCFMDDSPYNIVLSPHYPKQRMGSTCDKDRLLEMQQVVLHIHENLDTRDHPPNSTLIPRKEHISESVKLLCIPQIQSSGENFHCQNPLVRCCSNIIKSRVSRKEMSIAMLLLKRCYATQPEDFLVSIPFLIPYFVNFNDKKKEVTFILTSFRHQLASVFFNSIISSVNPHLGFSVCKAVLLKNSLVDACLSSQNAYTLDLQVGVKRGLESVQQGIHTSASFATTTFTQLVSGSITGRIFKLYFAQIYGNKSQGIIYLEVMIYSFLPSGLKIWTSSIIIHIFSLIGFLFSTFFFLLSVFPFPLFGSLTFDWITITPFIKVHIIVNHFHENFYENSKLSEIVANFYFFKMSRGECFTLRCFERALNIGNHSPNLETFLTGCDYPTYDPSHSFYVPKHHNVNIIFDVPAHQKILTLGVNTIHALLTGNYLLVYNSMEPLICWVIKFCSLSYDQINNRYAHEKMQTCVIIKASHAVSMIETAGDDSALSLSRLAISPVAKQPDLSCALVIFEFKAFCCIRLWKLYSNGCSHVVNMADGSIPAAEPSTFYAPTVVELYVYSLSNNTYASKHSQMNLKESFLSLLKEENDDNIKDSEHPRLVSHIKIKLMTLQGLKLSLYHGLPGRVPGYYYIMKPTGLTCKFNLNHNPDHHGFRSRFFLKSHIQKLDIRMLGSFPEKQAYCLMDERLVVLVSVTCYIYLHTTGRQEDSLSSLVTECKICAKFCSTVTKSDNLSSGSPLDYVVDSFIKQLRNKLNMEDELPSYPLDKTSFSFMIKDCCCFIVTLFITVEMVMRVVGVQLFEGLRDGDILSNESLQYTSLWEGYETCGWQGEIVPLDLDGGFGETHLNKHVEVRIEGREKEAPSEQVHQMISALQLDPGRATTTPSLVTQAPTTESLTSLCYDVGFGFVFLINFGFLVVLSYNCLSLVGRITLKRVYYVVLRVEFSCKHVVSQPVDCELLNNLIGKILVVLYLDDIIGKSRLAATTFKRLKVGMPFFPCKEMKRPKSSGKKQVAKLETIGKKCVLLSFQMDEFSFGHYITKFIRFCLHWKDTLLAYLSQRYLIWILFHANLHPGGGSWSLRLENIFEGRISGVVRVKPHILLNRHDKIHLHELAGGRTKLDHWVRLLSKAMNCLLREASLSPLRKMCGKMNSYTVSNEWVNSAPPNLILWGKIIEPVVSVLLHDWQTKFFIVVVIVVVVSHFHSHGLILIIKIYIHFLFSVSRLQQQKWHLCIHNQHLPWQETNQIGRSQTLILPSDIFGEGKSINSLSILLLRNIEALFTKIITFYSVIYQLKENCMKPHKARLQFLPLFASDMRCERIIHSAHIGLGDTELLFRSMISHHSSKRLELCCFINCAVRLMVFNKNHSKFQTLLPVTSILLALDLYQTLRREGGSEGSLRPGPGQDAAVASSSSPACQQLLVSSSMQTSCGKPPEEVPQLMLSAGNSLFLLGNSLFSSLCSRKPAVIFGGNFRCFTFLVLSCITHVATKVSLRIEPNVVTMGVKCTPDAQALLWFCSVYEIGRKETLDSKQNWRHSNEAKLMPCCPEQDLASHLVSLACNQWCAGKMFNNQLLRIESTWFAPFANFHGINTTTLDDFKLPTVMSLNTWLERDARSWLLQAWAKMLQHATGCSQSEGSYLIYVFMWTHTDTHTQTHPYTHTSMTKTIT

SEQ ID NO: 815674 - protein, 3017 aa, Homo sapiens
MDLFDFFRDWDLEQQCHYEQDRSALKKREWERRNQEVQQEDDLFSSGFDLFGEPYKTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLVGCASMPTCCSGCSQISSIIDPSLYLYQRTDGHWWNSTHWGTFSLVMFVFMLLLLSVKNRSHCKLTLQLKGSVRIYYLVIFFLLAFDMHFSDSTIFLCFMDDSPYNIVLSPHYPKQRMGSTCDKDRLLEMQQVVLHIHENLDTRDHPPNSTLIPRKEHISESVKLLCIPQIQSSGENFHCQNPLVRCCSNIIKSRVSRKEMSIAMLLLKRCYATQPEDFLVSIPFLIPYFVNFNDKKKEVTFILTSFRHQLASVFFNSIISSVNPHLGFSVCKAVLLKNSLVDACLSSQNAYTLDLQVGVKRGLESVQQGIHTSASFATTTFTQLVSGSITGRIFKLYFAQIYGNKSQGIIYLEVMIYSFLPSGLKIWTSSIIIHIFSLIGFLFSTFFFLLSVFPFPLFGSLTFDWITITPFIKVHIIVNHFHENFYENSKLSEIVANFYFFKMSRGECFTLRCFERALNIGNHSPNLETFLTGCDYPPYDPSHSFYVPKHHNVNIIFDVPAHQKILTLGVNTIHALLTGNYLLVYNSMEPLICWVIKFCSLSYDQINNRYAHEKMQTCVIIKASHAVSMIETAGDDSALSLSRLAISPVAKQPDLSCALVIFEFKAFCCIRLWKLYSNGCSHVVNMADGSIPAAEPSTFYAPTVVELYVYSLSNNTYASKHSQMNLKESFLSLLKEENDDNIKDSEHPRLVSHIKIKLMTLQGLKLSLYHGLPGRVPGYYYIMKPTGLTCKFNLNHNPDHHGFRSRFFLKSHIQKLDIRMLGSFPEKQAYCLMDERLVVLVSVTCYIYLHTTGRQEDSLSSLVTECKICAKFCSTVTKSDNLSSGSPLDYVVDSFIKQLRNKLNMEDELPSYPLDKTSFSFMIKDCCCFIVTLFITVYMVMRVVGVQLFEGLRDGDILSNESLQYTSLWEGYETCGWQGEIVPLDLDGGFGETHLNKHVEVRIEGREKEAPSEQVHQMISALQLDPGRATTTPSLVTQAPTTESLTSLCYDVGFGFVFLINFGFLVVLSYNCLSLVGRITLKRVYYVVLRVEFSCKHVVSQPVDCELLNNLIGKILVVLYLDDIIGKSRLAATTFKRLKVGMPFFPCKEMKRPKSSGKKQVAKLETIGKKCVLLSFQMDEFSFGHYITKFIRFCLHWKDTLLAYLSQRYLIWILFHANLHPGGGSWSLRLENIFEGRISGVVRVKPHILLNRHDKIHLHELAGGRTKLDHWVRLLSKAMNCLLREASLSPLRKMCGKMNSYTVSNEWVNSAPPNLILWGKIIEPVVSVLLHDWQTKFFIVVVIVVVVSHFHSHGLILIIKIYIHFLFSVSRLQQQKWHLCIHNQHLPWQETNQIGRSQTLILPSDIFGEGKSINSLSILLLRNIEALFTKIITFYSVIYQLKENCMKPHKARLQFLPLFASDMRCERIIHSAHIGLGDTELLFRSMISHHSSKRLELCCFINCAVRLMVFNKNHSKFQTLLPVTSILLACDLYQTLRREGGSEGSLRPGPWQDAAVASSSSPACQQLLVSSSMQTSCGKPPEEVPQLMLSAGNSLFLLGNSLFSSLCSRKPAVIFGGNFRCFTFLVLSCITHVATKVSLRIEPNVVTMGVKCTPDAQALLWFCSVYEIGRKETLDSKQNWRHSNEAKLMPCCPEQDLASHLVSLACNQWCAGKMFNNQLLRIESTWFAPFANFHGINTTTLDDFKLPTVMSLNTWLERDARSWLLQAWAKMLQHATGCSQSEGSYLIYVFMWTHTDTHTQTHPYTHTSMTKTIT

SEQ ID NO: 815675 - protein, 3054 aa, Homo sapiens
EPTAYVRPTDGQDQAPDISPTLKPSIEFENSFGNLHLEHSWMENPVHPVQKTKLPKFTILQTSETNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILREMTHSWPTPLTSMHTAGHSEQSTFSIPGQESQHLTPGFTLQKWNDPTTRASTKMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTILSATFAKDCVGCASMPTCCSGCSQISSIIDPSLYLYQRTDGHWWNSTHWGTFSLVMFVFMLLLLSVKNRSHCKLTLQLKGSVRIYYLVIFFLLAFDMHFSDSTIFLCFMDDSPYNIVLSPHYPKQRMGSTCDKDRLLEMQQVVLHIHENLDTRDHPPNSTLIPRKEHISESVKLLCIPQIQSSGENFHCQNPLVRCCSNIIKSRVSRKEMSIAMLLLKRCYATQPEDFLVSIPFLIPYFVNFNDKKKEVTFILTSFRHQLASVFFNSIIWSVNPHLGFSVCKAVLLKNSLVDACLSSQNAYTLDLQVGVKRGLESVQQGIHTSASFATTTFTQLVSGSITGRIFKLYFAQIYGNKSQGIIYLEVMIYSFLPSGLKIWTSSIIIHIFSLIGFLFSTFFFLLSVFPFPLFGSLTFDWITITPFIKVHIIVNHFHENFKENSKLSKVVANFYFFKMSRGECFTLRCFERALNIGNHSPNLETFLTGCDYPTYDPSHSFYVPKHHNVNIIFDVPAHQKILTLGVNTIHALLTGNYLLVYNSMEPLICWVIKFCSLSYDQINNRYAHEEMQTCVIIKASHAVSMIETAGDDSALSLSRLAISPVAKQPDLSCALVIFEFKAFCCIRLWKLYSNGCSHVVNMADGSIPAAEPSTFYAPTVVELYVYSLSNNTYASKHSQMNLKESFLSLLKEENDDNIKDSEHPRLVSHIKIKLMTLQGLKLSLYHGLPGRVPGYYYIMKPTGLTCKFNLNHNPDHHGFRSRFFLKSHIQKLDIRMLGSFPEKQAYCLMDERLVVLVSVTCYIYLHTTGRQEDSLSSLVTECKICAKFCSTVTKSDNLSSGSPLDYVVDSFIKQLRNKLNMEDELPSYPLDKTSFSFMIKDCCCFIVTLFITVYMVMRVVGVQLFEGLRDGDILSNESLQYTSLWEGYETCGWQGEIVPLDLDGGFGETHLNKHVEVRIEGREKEAPSEQVHQMISALQLDPGRATTTPSLVTQAPTTESLTSLCYDVGFGFVFLINFGFLVVLSYNCLSLVGRITLKRVYSVVLRVEFSCKHVVSQPVDCELLNNLIGKILVVLYLDDIIGKSRLAATTFKRLKVGMPFFPCKEMKRPKIFRQKASCKIRNHWLKMCFVGFQMDEFSFGHYITKFIRFCLHWKDTLLAYLSQRYLIWILFHANLHPGGGSWSLRLENIFEGRISWVVRVKPHILLNRHDKIHLHELAGGRTKLDHWVRLLSKAMNCLLREASLSPLRKMCGKMNSYTVSNEWVNSAPPNLILWGKIIEPVVSVLLHDWQTKFFIVVVIVVVVSHFHSHGLILIIKIYIHFLFSVSRLQQQKWHLCIHNQHLPWQETNQIGRSQTLILPSDIFGEGKSINSLSILLLRNIEALFTKIITFYSVIYQLKEIALKPHKARLQFLPLFASDMRCERIIHSAHIGLGDTELLFRSMISHHSSKRLELCCFINCAVRLMVFNKNHSKFQTLLPVTSILLALDLYQTLRREGGSEGSLRPGPWQDAAVASSSSPACQQLLVSSSMQTSCGKPPEEVPQLMLSAGNSLFLLGNSLFSSLCSRKPAVIFGGNFRCFTFLVLSCITHVATKVSLRIEPNVVTMGVKCTPDAQALLWFCSVYEIGRKETLDSKQNWRHSNEAKLMPCCPEQDLASHLVSLACNQWCAGKMFNNQLAEKESTWFAPFANFHGINTTTLDDFKLPTVMSLNTWLERDARSWLLQAWAKMLQHATGCSQSEGSYLIYVFMWTHTDTHTQTHPYTHTSMTKTIT

SEQ ID NO: 815676 - protein, 1419 aa, Homo sapiens
MVFCSNLWEQKSRYHYLEVMIYSFLPSGLKIWTSSIIIHIFSLIGFLFSTFFFLLSVFPFPLFGSLTFDWITITPFIKVHIIVNHFHENFYENSKLSKYVANFYFFKMSRGVCFTLRCFERALNIGNHSPNLETFLTGCDYPTYDPSHSFYVPKHHNVNIIFDVPAHQKILTLGVNTIHALLTGNYLLVYNSMEPLICWVIKFCSLSYDQINNRYAHEKMQTCVIIKASHAGSMIETAGDDSALSLSRLAISPVAKQPDLSCALVIFEFKAFCCIRLWKLYSNGRSHVVNMADGSIPAAEPSTFYAPTVVELYVYSLSNNTYASKHSQMNLKESFLSLLKEENDDNIKDSEHPRLVSHIKIKLMTLQGLKLSLYHGLPGRVPGYYYIMKPTGLTCKFNLNHNPDHHGFRSRFFLKSHIQKLDIRMLGSFPEKQAYCLMDERLVVLVSVTCYIYLHTTGRQEDSLSSLVTECKICAKFCSTVTKSDNLSSGSPLDYVVDSFIKQLRNKLNMEDELPSYPLDKTSFSFMIKDCCCFIVTLFITVYMVMRVVGVQLFEGLRDGDILSNESLQYTSLWEGYETCGWQGEIVPLDLDGGFGETHLNKHVEVRIEGRVKGSSSEQVHQMISALQLDPGRATTTPSLVTQAPTTESLTSLCYDVGFGFVFLINFGFLVVLSYNCLSLVGRITLKRVYSVVLRVEFSCKHVVSQPVDCELLNNLIGKILVVLYLDDIIGKSRLAATTFKRLKVGMPFFPCKEMKRPKSSGKKQVAKLETIGKKCVLLSFQMDEFSFGHYITKFIRFCLHWKDTLLAYLSQRYLIWILFHANLHPGGGSWSLRLENIFEGRISGVVRVKPHILLNRHDKIHLHELAGGRTKLDHWVRLLSKAMNCLLREASLSPLRKMCGKMNSYTVSNEWVNSAPPNLILWGKIIEPVVSVLLHDWQTKFFIVVVIVVVVSHFHSHGLILIIKIYIHFLFSVSRLQQQKWHLCIHNQHLPWQETNQIGRSQTLILPSDIFGEGKSINSLSILLLRNIEALFTKIITFYSVIYQLKENCMKPHKARLQFLPLFASDMRCERIIHSAHIGLGDTELLFRSMISHHSSKRLELCCFINCAVRLMVFNKNHSKFQTLLPVTSILLALDLYQTLRREGGSEGSLRPGPWQDAAVASSSSPACQQLLVSSSMQTSCGKPPEEVPQLMLSAGNSLFLLGNSLFSSLCSRKPAVIFGGNFRCFTFLVLSCITHVATKVSLRIEPNVVTMGVKCTPDAQALLWFCSVYEIGRKETLDSKQNWRHSNEAKLMPCCPEQDLASHLVSLACNQWCAGKMFNNQLLRIESTWFAPFANFHGINTTTLDDFKLPTVMSLNTWLERDARSWLLQAWAKMLQHATGCSQSEGSYLIYVFMWTHTDTHTQTHPYTHTSMTKTIT

SEQ ID NO: 815677 - protein, 372 aa, Homo sapiens [sequence omitted]

SEQ ID NO: 815678 - protein, 379 aa, Homo sapiens [sequence omitted]

SEQ ID NO: 815679 - protein, 310 aa, Homo sapiens
MSLGKLSPVGWVSSSQGKRRLTADMISHPLGDFRHTMHVGRGGDVFGDTSFLSNHGGSSGSTHRSPRSFLAKKLQLVRRVGAPPRRMASPPAPSPAPPAISPIIKNAISLPQLNQAAYDSLVVGKLSFDSSPTSSTDGHSSYGLDSGFCTISRLPRSEKPHDRDRDGSFPSEPGLRRSDSLLSFRLDLDLGPSLLSELLGVMSLSGYSGPRQPDSVTISWTRQNGEAVKTHTNISESHPNATFSDHRVTTSIREDDWNSGKSFTRTVTHTDPPSTLKQTISRPKGEILHSPDVYSQPPTREQHEPVGLVG

SEQ ID NO: 815680 - protein, 367 aa, Homo sapiens [sequence omitted]

SEQ ID NO: 815681 - protein, 379 aa, Homo sapiens [sequence omitted]

SEQ ID NO: 815682 - protein, 201 aa, Homo sapiens
MSLGKLSPVGWVSSSQGKRRLTADMISHPLGDFRHTMHVGRGGDVFGDTSFLSNHGGSSGSTHRSPRSFLAKKLQLVRRVGAPPRRMASPPAPSPAPPAISPIIKNAISLPQLNQAAYDSLVVGKLSFDSSPTSSTDGHSSYGLDSGFCTISRLPRSEKPHDRDRDGSFPSEPGLRRSDSLLLLRTHPNPTPNHISYSPEG

SEQ ID NO: 815683 - protein, 178 aa, Homo sapiens [sequence omitted]

SEQ ID NO: 815684 - protein, 151 aa, Homo sapiens
LQHSLDFEKSSTEGSESSIMGNSIDTVRYGKESDLGDVSEEHGENKESSNNEQDNSLLEQYLTSVQQLEDADERTNFDTETRDSKLHIACFPVQLDTLSDGASVDESHGISPPLQGEISQTQENSKLNAEVQGQQPECDSTFQLLHVGVTV

SEQ ID NO: 815685 - protein, 151 aa, Homo sapiens; identical to SEQ ID NO: 815684

SEQ ID NO: 815686 - protein, 151 aa, Homo sapiens; identical to SEQ ID NO: 815684

SEQ ID NO: 815687 - protein, 151 aa, Homo sapiens; identical to SEQ ID NO: 815684

SEQ ID NO: 815688 - protein, 326 aa, Homo sapiens
MATLVELPDSVLLEIFSYLPVRDRIRISRVCHRWKRLVDDRWLWRHVDLTLYTMRPKVMWHLLRRYMASRLHSLRMGGYLFSGSQAPQLSPALLRALGQKCPNLKRLCLHVADLSMVPITSLPSTLRTLELHSCEISMAWLHKQQDPTVLPLLECIVLDRVPAFRDEHLQGLTRFRALRSLVLGGTYRVTETGLDAGLQELSYLQRLEVLGCTLSADSTLLAISRHLRDVRKIRLTVRGLSAPGLAVLEGMPALESLCLQGPLVTPEMPSPTEILSSCLTMPKLRVLELQGLGWEGQEAEKILCKGLPHCMVIVRACPKESMDWWM

SEQ ID NO: 815689 - protein, 273 aa, Homo sapiens
MRPKVMWHLLRRYMASRLHSLRMGGYLFSGSQAPQLSPALLRALGQKCPNLKRLCLHVADLSMVPITSLPSTLRTLELHSCEISMAWLHKQQDPTVLPLLECIVLDRVPAFRDEHLQGLTRFRALRSLVLGGTYRVTETGLDAGLQELSYLQRLEVLGCTLSADSTLLAISRHLRDVRKIRLTVRGLSAPGLAVLEGMPALESLCLQGPLVTPEMPSPTEILSSCLTMPKLRVLELQGLGWEGQEAEKILCKGLPHCMVIVRACPKESMDWWM

SEQ ID NO: 815690 - protein, 273 aa, Homo sapiens; identical to SEQ ID NO: 815689

SEQ ID NO: 815691 - protein, 407 aa, Homo sapiens
LGLSSQSRPNHASATSRKPLTASATLSRLVSGPHPRLVRPWDRITSQREEGQISRPATGRSRPPPCQPPRRPQDPSGLFNRKRKCVSAGSWRLWSNCRTRSCSRSSLTSRVCHRWKRLVDDRWLWRHVDLTLYTMRPKVMWHLLRRYMASRLHSLRMGGYLFSGSQAPQLSPALLRALGQKCPNLKRLCLHVADLSMVPITSLPSTLRTLELHSCEISMAWLHKQQDPTVLPLLECIVLDRVPAFRDEHLQGLTRFRALRSLVLGGTYRVTETGLDAGLQELSYLQRLEVLGCTLSADSTLLAISRHLRDVRKIRLTVRGLSAPGLAVLEGMPALESLCLQGPLVTPEMPSPTEILSSCLTMPKLRVLELQGLGWEGQEAEKILCKGLPHCMVIVRACPKESMDWWM

SEQ ID NO: 815692 - protein, 391 aa, Homo sapiens
LVLVPSRGQITPQPPPASLSLPQPRFPGWFLVPIRGWSGPGTESLPSERKVKFLDRLREGRGRRPVSRLGAPRTPRVSLTGSGSACRRDHGDFGRTAGLGPARDLLLPPGTGPDPHLQMRPKVMWHLLRRYMASRLHSLRMGGYLFSGSQAPQLSPALLRALGQKCPNLKRLCLHVADLSMVPITSLPSTLRTLELHSCEISMAWLHKQQDPTVLPLLECIVLDRVPAFRDEHLQGLTRFRALRSLVLGGTYRVTETGLDAGLQELSYLQRLEVLGCTLSADSTLLAISRHLRDVRKIRLTVRGLSAPGLAVLEGMPALESLCLQGPLVTPEMPSPTEILSSCLTMPKLRVLELQGLGWEGQEAEKILCKGLPHCMVIVRACPKESMDWWM

SEQ ID NO: 815693 - protein, 440 aa, Homo sapiens
LGLSSQSRPNHASATSRKPLTASATLSRLVSGPHPRLVRPWDRITSQREEGQISRPATGRSRPPPCQPPRRPQDPSGLFNRKRKCVSAGSWRLWSNCRTRSCSRSSLTSRVCHRWKRLVDDRWLWRHVDLTLYTAGVQWYDLSSLQPLPPGFKVIPLPQPPEKLGLQMRPKVMWHLLRRYMASRLHSLRMGGYLFSGSQAPQLSPALLRALGQKCPNLKRLCLHVADLSMVPITSLPSTLRTLELHSCEISMAWLHKQQDPTVLPLLECIVLDRVPAFRDEHLQGLTRFRALRSLVLGGTYRVTETGLDAGLQELSYLQRLEVLGCTLSADSTLLAISRHLRDVRKIRLTVRGLSAPGLAVLEGMPALESLCLQGPLVTPEMPSPTEILSSCLTMPKLRVLELQGLGWEGQEAEKILCKGLPHCMVIVRACPKESMDWWM

SEQ ID NO: 815694 - protein, 484 aa, Homo sapiens
LVLVPSRGQITPQPPPASLSLPQPRFPGWFLVPIRGWSGPGTESLPSERKVKFLDRLREGRGRRPVSRLGAPRTPRVSLTGSGSACRRDHGDFGRTAGLGPARDLLLPPGTGPDPHLQGLSPLEEAGGRPVAVATCRPDALHVETGFCHVGQDGLNLLTSCSARIGLPKCWDYGHEPLRPGFFLIFSCCRHVKKCLSPPAMILRPPQPCGTMRPKVMWHLLRRYMASRLHSLRMGGYLFSGSQAPQLSPALLRALGQKCPNLKRLCLHVADLSMVPITSLPSTLRTLELHSCEISMAWLHKQQDPTVLPLLECIVLDRVPAFRDEHLQGLTRFRALRSLVLGGTYRVTETGLDAGLQELSYLQRLEVLGCTLSADSTLLAISRHLRDVRKIRLTVRGLSAPGLAVLEGMPALESLCLQGPLVTPEMPSPTEILSSCLTMPKLRVLELQGLGWEGQEAEKILCKGLPHCMVIVRACPKESMDWWM

SEQ ID NO: 815695 - protein, 293 aa, Homo sapiens
MATLVELPDSVLLEIFSYLPMRPKVMWHLLRRYMASRLHSLRMGGYLFSGSQAPQLSPALLRALGQKCPNLKRLCLHVADLSMVPITSLPSTLRTLELHSCEISMAWLHKQQDPTVLPLLECIVLDRVPAFRDEHLQGLTRFRALRSLVLGGTYRVTETGLDAGLQELSYLQRLEVLGCTLSADSTLLAISRHLRDVRKIRLTVRGLSAPGLAVLEGMPALESLCLQGPLVTPEMPSPTEILSSCLTMPKLRVLELQGLGWEGQEAEKILCKGLPHCMVIVRACPKESMDWWM

SEQ ID NO: 815696 - protein, 336 aa, Homo sapiens
LGLSSQSRPNHASATSRKPLTASATLSRLVSGPHPRLVRPWDRITSQREEGQISRPATGRSRPPPCQPPRRPQDPSGLFNRKRKCVSAGSWRLWSNCRTRPALLRALGQKCPNLKRLCLHVADLSMVPITSLPSTLRTLELHSCEISMAWLHKQQDPTVLPLLECIVLDRVPAFRDEHLQGLTRFRALRSLVLGGTYRVTETGLDAGLQELSYLQRLEVLGCTLSADSTLLAISRHLRDVRKIRLTVRGLSAPGLAVLEGMPALESLCLQGPLVTPEMPSPTEILSSCLTMPKLRVLELQGLGWEGQEAEKILCKGLPHCMVIVRACPKESMDWWM

SEQ ID NO: 815697 - protein, 326 aa, Homo sapiens; identical to SEQ ID NO: 815688

SEQ ID NO: 815698 - protein, 134 aa, Homo sapiens
MATLVELPDSVLLEIFSYLPVRDRIRISRVCHRWKRLVDDRWLWRHVDLTLYTVRAAGRAGLGRGRGARTPKTTSPTLGLCVGARAGDLEPGDPGPISASSLTSSSSTSGPQFPHPCNGDKGQYLPHGAIMGLH

SEQ ID NO: 815699 - protein, 476 aa, Homo sapiens [sequence omitted]

SEQ ID NO: 815700 - protein, 451 aa, Homo sapiens
MGRKEEDDCSSWKKQTTNIRKTFIFMEVLGSGAFSEVFLVKQRLTGKLFALKCIKKSPAFRDSSLENEIAVLKKIKHENIVTLEDIYESTTHYYLVMQLVSGGELFDRILERGVYTEKDASLVIQQVLSAVKYLHENGIVHRDLKPENLLYLTPEENSKIMITDFGLSKMEQNGIMSTACGTPGYVGSVDTPHSMKKRSLSFSRRSRRATMSLSLHSGMTFLSQPRTLFATCLRRIQNERYTCEKALSHPWIDGNTALHRDIYPSVSLQIQKNFAKSKWRQAFNAAAVVHHMRKLHMNLHSPGVRPEVENRPPETQASETSRPSSPEITITEAPVLDHSVALPALTQLPCQHGRRPTAPGGRSLNCLVNGSLHISSSLVPMHQGSLAAGPCGCCSSCLNIGSKGKSSYCSEPTLLKKANKKQNFKSEVMVPVKASGSSHCRAGQTGVCLIM

SEQ ID NO: 815701 - protein, 35 aa, Homo sapiens
MNLHSPGVRPEVENRPPETQASETSRPSSPEITIT

SEQ ID NO: 815702 - protein, 697 aa, Homo sapiens
MARLVAVCRDGEEEFPFERRQIPLYIDDTLTMVMEFPDNVLNLDGHQNNGAQLKQFIQRHGMLKQQDLSIAMVVTSREVLSALSQLVPCVGCRRSVERLFSQLVESGNPALEPLTVGPKGVLSVTRSCMTDAKKLYTLFYVHGSKLNDMIDAIPKSKKNKRCQLHSLDTHKPKPLGGCWMDVWELMSQECRDEVVLIDSSCLLETLETYLRKHRFCTDCKNKVLRAYNILIGELDCSKEKGYCAALYEGLRCCPHERHIHVCCETDFIAHLLGRAEPEFAGGRRERHAKTIDIAQEEVLTCLGIHLYERLHRIWQKLRAEEQTWQMLFYLGVDALRKSFEMTVEKVQGISRLEQLCEEFSEEERVRELKQEKKRQKRKNRRKNKCVCDIPTPLQTADEKEVSQEKETDFIENSSCKACGSTEDGNTCVEVIVTNENTSCTCPSSGNLLGSPKIKKGLSPHCNGSDCGYSSSMEGSETGSREGSDVACTEGICNHDEHGDDSCVHHCEDKEDDGDSCVECWANSEENDTKGKNKKKKKKSKILKCDEHIQKLGSCITDPGNRETSGNTMHTVFHRDKTKDTHPESCCSSEKGGQPLPWFEHRKNVPQFAEPTETLFGPDSGKGAKSLVELLDESECTSDEEIFISQDEIQSFMANNQSFYSNREQYRQHLKEKFNKYCRLNDHKRPICSGWLTTAGAN

SEQ ID NO: 815703 - protein, 288 aa, Homo sapiens
MARLVAVCRDGEEEFPFERRQIPLYIDDTLTMVMEFPDNVLNLDGHQNNGAQLKQFIQRHGMLKQQDLSIAMVVTSREVLSALSQLVPCVGCRRSVERLFSQLVESGNPALEPLTVGPKGVLSVTRSCMTDAKKLYTLFYVHGSKLNDMIDAIPKSKKNKRCQLHSLDTHKPKPLGGCWMDVWELMSQECRDEVVLIDSSCLLETLETYLRKHRFCTDCKNKVLRAYNILIGELDCSKEKGYCAALYEGLRCCPHERHIHVCCETDFIAHLLGRAEPEFAGGYEYVIC

SEQ ID NO: 815704 - protein, 149 aa, Homo sapiens
STIFAEYSIWCRCLRKSFEMTVEKVQGISRLEQLCEEFSEEERVRELKQEKKRQKRKNRRKNKCVCDIPTPLQTADEKEVSQEKETDFIENSSCKACGSTEDGNTCVEVIVTNENTSCTCPSSGNLLGSPKIKKGLSPHCNGRTDGVPS

SEQ ID NO: 815705 - protein, 288 aa, Homo sapiens; identical to SEQ ID NO: 815703

SEQ ID NO: 815706 - protein, 520 aa, Homo sapiens
ILDAVDGRECHHLVHCYMPQEIIAQPFLNFKVFLFNRFCTDCKNKVLRAYNILIGELDCSKEKGYCAALYEGLRCCPHERHIHVCCETDFIAHLLGRAEPEFAGGRRERHAKTIDIAQEEVLTCLGIHLYERLHRIWQKLRAEEQTWQMLFYLGVDALRKSFEMTVEKVQGISRLEQLCEEFSEEERVRELKQEKKRQKRKNRRKNKCVCDIPTPLQTADEKEVSQEKETDFIENSSCKACGSTEDGNTCVEVIVTNENTSCTCPSSGNLLGSPKIKKGLSPHCNGSDCGYSSSMEGSETGSREGSDVACTEGICNHDEHGDDSCVHHCEDKEDDGDSCVECWANSEENDTKGKNKKKKKKSKILKCDEHIQKLGSCITDPGNRETSGNTMHTVFHRDKTKDTHPESCCSSEKGGQPLPWFEHRKNVPQFAEPTETLFGPDSGKGAKSLVELLDESECTSDEEIFISQDEIQSFMANNQSFYSNREQYRQHLKEKFNKYCRLNDHKRPICSGWLTTAGAN

SEQ ID NO: 815707 - protein, 457 aa, Homo sapiens
MARLVAVCRDGEEEFPFERRQIPLYIDDTLTMVMEFPDNVLNLDGHQNNGAQLKQFIQRHGMLKQQDLSIAMVVTSREVLSALSQLVPCVGCRRSVERLFSQLVESGNPALEPLTVGPKGVLSVTRSCMTDAKKLYTLFYVHGSKLNDMIDAIPKSKKNKRCQLHSLDTHKPKPLGGCWMDVWELMSQECRDEVVLIDSSCLLETLETYLRKHRFCTDCKNKVLRAYNILIGELDCSKEKGYCAALYEGLRCCPHERHIHVCCETDFIAHLLGRAEPEFAGGRRERHAKTIDIAQEEVLTCLGIHLYERLHRIWQKLRAEEQTWQMLFYLGVDALRKSFEMTVEKVQGISRLEQLCEEFSEEERVRELKQEKKRQKRKNRRKNKCVCDIPTPLQTADEKEVSQEKETDFIENSSCKACGSTEDGNTCVEVIVTNENTSCTCPSSGNLLGSPKIKKGK

SEQ ID NO: 815708 - protein, 697 aa, Homo sapiens; identical to SEQ ID NO: 815702

SEQ ID NO: 815709 - protein, 411 aa, Homo sapiens
MARLVAVCRDGEEEFPFERRQIPLYIDDTLTMVMEFPDNVLNLDGHQNNGAQLKQFIQRHGMLKQQDLSIAMVVTSREVLSALSQLVPCVGCRRSVERLFSQLVESGNPALEPLTVGPKGVLSVTRSCMTDAKKLYTLFYVHGSKLNDMIDAIPKSKKNKRCQLHSLDTHKPKPLGGCWMDVWELMSQECRDEVVLIDSSCLLETLETYLRKHRFCTDCKNKVLRAYNILIGELDCSKEKGYCAALYEGLRCCPHERHIHVCCETDFIAHLLGRAEPEFAGGRRERHAKTIDIAQEEVLTCLGIHLYERLHRIWQKLRAEEQTWQMLFYLGVDALRKSFEMTVEKVQGISRLEQLCEEFSEEERVRELKQEKKRQKRKNRRKNKCVCDIPTPLQTADEKEVSQEKLPQRHS

SEQ ID NO: 815710 - protein, 330 aa, Homo sapiens
YSISSSENSSQSCSNLLIPCTFSTVISKLLRKHQYQDEETDFIENSSCKACGSTEDGNTCVEVIVTNENTSCTCPSSGNLLGSPKIKKGLSPHCNGSDCGYSSSMEGSETGSREGSDVACTEGICNHDEHGDDSCVHHCEDKEDDGDSCVECWANSEENDTKGKNKKKKKKSKILKCDEHIQKLGSCITDPGNRETSGNTMHTVFHRDKTKDTHPESCCSSEKGGQPLPWFEHRKNVPQFAEPTETLFGPDSGKGAKSLVELLDESECTSDEEIFISQDEIQSFMANNQSFYSNREQYRQHLKEKFNKYCRLNDHKRPICSGWLTTAGAN

SEQ ID NO: 815711 - protein, 457 aa, Homo sapiens; identical to SEQ ID NO: 815707

SEQ ID NO: 815712 - protein, 457 aa, Homo sapiens; identical to SEQ ID NO: 815707

SEQ ID NO: 815713 - protein, 685 aa, Homo sapiens
MARLVAVCRDGEEEFPFERRQIPLYIDDTLTMVMEFPDNVLNLDGHQNNGAQLKQFIQRHGMLKQQDLSIAMVVTSREVLSALSQLVPCVGCRRSVERLFSQLVESGNPALEPLTVGPKGVLSVTRSCMTDAKKLYTLFYVHGSKLNDMIDAIPKSKKNKRCQLHSLDTHKPKPLGGCWMDVWELMSQECRDEVVLIDSSCLLETLETYLRKHRFCTDCKNKVLRAYNILIGELDCSKEKGYCAALYEGLRCCPHERHIHVCCETDFIAHLLGRAEPEFAGGRRERHAKTIDIAQEEVLTCLGIHLYERLHRIWQKLRAEEQTWQMLFYLGVDALRKSFEMTVEKVQGISRLEQLCEEFSEEERVRELKQEKKRQKRKNRRKNKCVCDIPTPLQTADEKEVSQEKETDFIENSSCKACGSTEDGNTCVEVIVTNENTSCTCPSSGNLLGSPKIKKGLSPHCNGSDCGYSSSMEGSETGSREGSDVACTEGICNHDEHGDDSCVHHCEDKEDDGDSCVECWANSEENDTKGKNKKKKKKSKILKCDEHIQKLGSCITDPGNRETSGNTMHTVFHRDKTKDTHPESCCSSEKGGQPLPWFEHRKNVPQFAEPTETLFGPDSGKGAKSLVELLDESECTSDEEIFISQDEIQSFMANNQSFYSNREQYRQHLKEKFNASNRDPSSRLQ

SEQ ID NO: 815714 - protein, 130 aa, Homo sapiens [sequence omitted]

SEQ ID NO: 815715 - protein, 457 aa, Homo sapiens; identical to SEQ ID NO: 815707

SEQ ID NO: 815716 - protein, 143 aa, Homo sapiens
MARLVAVCRDGEEEFPFERRQIPLYIDDTLTMVMEFPDNVLNLDGHQNNGAQLKQFIQRHGMLKQQDLSIAMVVTSREVLSALSQLVPCVGCRRSVERLFSQLVESGNPALEPLTVGPKGVLSVTRSCMTDAKKLYTLFYVHG

SEQ ID NO: 815717 - protein, 126 aa, Homo sapiens
DDCVLFDRHLISRMRPENEYIIFLVNFQWKGLTSACLHIRYLSTGLFSFLFFDLFVIACTSLCNFPLDLYYRLLVFLVLKVHKFKKEISGWPLWTLSGHTSSLSSAVYPGFPQTEASAAPRSPCSP

SEQ ID NO: 815718 - protein, 126 aa, Homo sapiens; identical to SEQ ID NO: 815717

SEQ ID NO: 815719 - protein, 126 aa, Homo sapiens; identical to SEQ ID NO: 815717

SEQ ID NO: 815720 - protein, 126 aa, Homo sapiens; identical to SEQ ID NO: 815717

SEQ ID NO: 815721 - protein, 673 aa, Homo sapiens
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDRKARYLKNIFISKHSSEESGYASVAGQSLPGPMVDQSPSVSTSFGLSAMSPTKAAVDSLMTIGQSLLQGTLQPPAGPEEPTLAGGGRHPGVAEVKTEMMQVDEVPSQDSPGAAESSISGGMGDKVEERGKEGPGTPTRSSVITSARELHYGREESAEQVPPPAEAGQAPTGRPEHPAPPPEKHLGIYSVLPNHKADAVLSMPSSVTSGLHVQPALAVSMDFSTYGGLLPQGFIQRELFSKLGELAVGMKSESRTIGEQCSVCGVELPDNEAVEQHRKLHSGMKTYGCELCGKRFLDSLRLRMHLLAHSAGAKAFVCDQCGAQFSKEDALETHRQTHTGTDMAVFCLLCGKRFQAQSALQQHMEVHAGVRSYICSECNRTFPSHTALKRHLRSHTGDHPYECEFCGSCFRDESTLKSHKRIHTGEKPYECNGCGKKFSLKHQLETHYRVHTGEKPFECKLCHQRSRDYSAMIKHLRTHNGASPYQCTICTEYCPSLSSMQKHMKGHKPEEIPPDWRIEKTYLYLCYV

SEQ ID NO: 815722 - protein, 673 aa, Homo sapiens; identical to SEQ ID NO: 815721

SEQ ID NO: 815723 - protein, 705 aa, Homo sapiens
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDRKARYLKNIFISKHSSEESGYASVAGQSLPGPMVDQSPSVSTSFGLSAMSPTKAAVDSLMTIGQSLLQGTLQPPAGPEEPTLAGGGRHPGVAEVKTEMMQVDEVPSQDSPGAAESSISGGMGDKVEERGKEGPGTPTRSSVITSARELHYGREESAEQVPPPAEAGQAPTGRPEHPAPPPEKHLGIYSVLPNHKADAVLSMPSSVTSGLHVQPALAVSMDFSTYGGLLPQGFIQRELFSKLGELAVGMKSESRTIGEQCSVCGVELPDNEAVEQHRVFSITFVPVGNTSFWTVKMHFLRCEMSGPCVWKLHSGMKTYGCELCGKRFLDSLRLRMHLLAHSAGAKAFVCDQCGAQFSKEDALETHRQTHTGTDMAVFCLLCGKRFQAQSALQQHMEVHAGVRSYICSECNRTFPSHTALKRHLRSHTGDHPYECEFCGSCFRDESTLKSHKRIHTGEKPYECNGCGKKFSLKHQLETHYRVHTGEKPFECKLCHQRSRDYSAMIKHLRTHNGASPYQCTICTEYCPSLSSMQKHMKGHKPEEIPPDWRIEKTYLYLCYV

SEQ ID NO: 815724 - protein, 290 aa, Homo sapiens
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDRKARYLKNIFISKHSSEESGYASVAGQSLPGPMVDQSPSVSTSFGLSAMSPTKAAVDSLMTIGQSLLQGTLQPPAGPEEPTLAGGGRHPGVAEVKTEMMQVDEVPSQDSPGAAESSISGGMGDKVEALRQPAQGLSAEGAGGV

SEQ ID NO: 815725 - protein, 252 aa, Homo sapiens
MFQPAPKRCFTIESLVAKDSPLPASRSEDPIRPAALSYANSSPINPFLNGFHSAAAAAAGRGVYSNPDLVFAEAVSHPPNPAVPVHPVPPPHALAAHPLPSSHSPHPLFASQQRDPSTFYPWLIHRYRYLGHRFQGNDTSPESFLLHNALARKPKRIRTAFSPSQLLRLEHAFEKNHYVVGAERKQLAHSLSLTETQVKVWFQNRRTKFKRQKLEEEGSDSQQKKKGTHHINRWRIATKQASPEEIDVTSDD

SEQ ID NO: 815726 - protein, 92 aa, Homo sapiens
AGAAGASELGARGEGAEKPGRPVGGRRLSRGGGADSVPLSARIQASGFPGAHLPLTHFKESPPFHLRASNSDQSSSHLPGFGGSCLCDPRTN

SEQ ID NO: 815727 - protein, 252 aa, Homo sapiens; identical to SEQ ID NO: 815725

SEQ ID NO: 815728 - protein, 252 aa, Homo sapiens; identical to SEQ ID NO: 815725

SEQ ID NO: 815729 - protein, 296 aa, Homo sapiens
MNTEPERKFGVVVVGVGRAGSVRMRDLRNPHPSSAFLNLIGFVSRRELGSIDGVQQISLEDALSSQEVEVAYICSESSSHEDYIRQFLNAGKHVLVEYPMTLSLAAAQELWELAEQKGKVLHEEHVELLMEEFAFLKKEVVGKDLLKGSLLFTAGPLEEERFGFPAFSGISRLTWLVSLFGELSLVSATLEERKEDQYMKMTVCLETEKKSPLSWIEEKGPGLKRNRYLSFHFKSGSLENVPNVGVNKNIFLKDQNIFVQKLLGQFSEKELAAEKKRILHCLGLAEEIQKYCCSRK

SEQ ID NO: 815730 - protein, 296 aa, Homo sapiens; identical to SEQ ID NO: 815729

SEQ ID NO: 815731 - protein, 197 aa, Homo sapiens [sequence omitted]

SEQ ID NO: 815732 - protein, 125 aa, Homo sapiens
MNTEPERKFGVVVVGVGRAGSVRMRDLRNPHPSSAFLNLIGFVSRRELGSIDGVQQISLEDALSSQEVEVAYICSESSSHEDYIRVFHTGSPCLTQQCSTAKMSKQAKTPCKGVRRASEKITIAL

SEQ ID NO: 815733 - protein, 167 aa, Homo sapiens
MLTVALLALLCASASGNAIQARSSSYSGEYGSGGGKRFSHSGNQLDGPITALRVRVNTYYIVGLQVRYGKVWSDYVGGRNGDLEEIFLHPGESVIQVSGKYKWYLKKLVFVTDKGRYLSFGKDSGTSFNAVPLHPNTVLRFISGRSGSLIDAIGLHWDVYPTSCSRC

SEQ ID NO: 815734 - protein, 887 aa, Homo sapiens
VVIATGKFKRVCGKEFGFHLFISPAQLSVEMESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNVKKSKQLLQKAVERGAVPLEMLEIALRNLNLQKKQLLSEEEKKNLSASTVLTAQESFSGSLGHLQNRNNSCDSRGQTTKARFLYGENMPPQDAEIGYRNSLRQTNKTKQSCPFGRVPVNLLNSPDCDVKTDDSVVPCFMKRQTSRSECRDLVVPGSKPSGNDSCELRNLKSVQNSHFKEPLVSDEKSSELIITDSITLKNKTESSLLAKLEETKEYQEPEVPESNQKQWQSKRKSECINQNPAASSNHWQIPELARKVNTEQKHTTFEQPVFSVSKQSPPISTSKWFDPKSICKTPSSNTLDDYMSCFRTPVVKNDFPPACQLSTPYGQPACFQQQQHQILATPLQNLQVLASSSANECISVKGRIYSILKQIGSGGSSKVFQVLNEKKQIYAIKYVNLEEADNQTLDSYRNEIAYLNKLQQHSDKIIRLYDYEITDQYIYMVMECGNIDLNSWLKKKKSIDPWERKSYWKNMLEAVHTIHQHGIVHSDLKPANFLIVDGMLKLIDFGIANQMQPDTTSVVKDSQVGTVNYMPPEAIKDMSSSRENGKSKSKISPKSDVWSLGCILYYMTYGKTPFQQIINQISKLHAIIDPNHEIEFPDIPEKDLQDVLKCCLKRDPKQRISIPELLAHPYVQIQTHPVNQMAKGTTEEMKYVLGQLVGLNSPNSILKAAKTLYEHYSGGESHNSSSSKTFEKKRGKK

SEQ ID NO: 815735 - protein, 305 aa, Homo sapiens
MCMRQNLQVLASSSANECISVKGRIYSILKQIGSGGSSKVFQVLNEKKQIYAIKYVNLEEADNQTLDSYRNEIAYLNKLQQHSDKIIRLYDYEITDQYIYMVMECGNIDLNSWLKKKKSIDPWERKSYWKNMLEAVHTIHQHGIVHSDLKPANFLIVDGMLKLIDFGIANQMQPDTTSVVKDSQVGTVNYMPPEAIKDMSSSRENGKSKSKISPKSDVWSLGCILYYMTYGKTPFQQIINQISKLHAIIDPNHEIEFPDIPEKDLQDVLKCCLKRDPKQRISIPELLAHPYVQIQTHPVNNGREH

SEQ ID NO: 815736 - protein, 239 aa, Homo sapiens
VVIATGKFKRVCGKEFGFHLFISPAQLSVEMESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNVKKSKQLLQKAVERGAVPLEMLEIALRNLNLQKKQLLSEEEKKNLSASYGY

SEQ ID NO: 815737 - protein, 197 aa, Homo sapiens
VVIATGKFKRVCGKEFGFHLFISPAQLSVEMESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNLKMSNSNFK

SEQ ID NO: 815738 - protein, 654 aa, Homo sapiens
VVIATGKFKRVCGKEFGFHLFISPAQLSVEMESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNVKKSKQLLQKAVERGAVPLEMLEIALRNLNLQKKQLLSEEEKKNLSASTVLTAQESFSGSLGHLQNRNNSCDSRGQTTKARFLYGENMPPQDAEIGYRNSLRQTNKTKQSCPFGRVPVNLLNSPDCDVKTDDSVVPCFMKRQTSRSECRDLVVPGSKPSGNDSCELRNLKSVQNSHFKEPLVSDEKSSELIITDSITLKNKTESSLLAKLEETKEYQEPEVPESNQKQWQSKRKSECINQNPAASSNHWQIPELARKVNTEQKHTTFEQPVFSVSKQSPPISTSKWFDPKSICKTPSSNTLDDYMSCFRTPVVKNDFPPACQLSTPYGQPACFQQQQHQILATPLQNLQVLASSSANECISVKGRIYSILKQIGSGGSSKVFQVLNEKKQIYAIKYVNLEEADNQTLDSYRNEIAYLNKLQQHSDKIIRLYDYEITDQYIYMVMECGNIDLNSWALFTVILNQLTF

SEQ ID NO: 815739 - protein, 834 aa, Homo sapiens
VVIATGKFKRVCGKEFGFHLFISPAQLSVEMESEDLSGRELTIDSIMNKVRDIKNKFKNEDLTDELSLNKISADTTDNSGTVNQIMMMANNPEDWLSLLLKLEKNSVPLSDALLNKLIGRYSQAIEALPPDKYGQNESFARIQVRFAELKAIQEPDDARDYFQMARANCKKFAFVHISFAQFELSQGNVKKSKQLLQKAVERGAVPLEMLEIALRNLNLQKKQLLSEEEKKNLSASTVLTAQESFSGSLGHLQNRNNSCDSRGQTTKARFLYGENMPPQDAEIGYRNSLRQTNKTKQSCPFGRVPVNLLNSPDCDVKTDDSVVPCFMKRQTSRSECRDLVVPGSKPSGNDSCELRNLKSVQNSHFKEPLVSDEKSSELIITDSITLKNKTESSLLAKLEETKEYQEPEVPESNQKQWQSKRKSECINQNPAASSNHWQIPELARKVNTEQKHTTFEQPVFSVSKQSPPISTSKWFDPKSICKTPSSNTLDDYMSCFRTPVVKNDFPPACQLSTPYGQPACFQQQQHQILATPLQNLQVLASSSANECISVKGRIYSILKQIGSGGSSKVFQVLNEKKQIYAIKYVNLEEADNQTLDSYRNEIAYLNKLQQHSDKIIRLYDYEITDQYIYMVMECGNIDLNSWLKKKKSIDPWERKSYWKNMLEAVHTIHQHGIVHSDLKPANFLIVDGMLKLIDFGIANQMQPDTTSVVKDSQVGTVNYMPPEAIKDMSSSRENGKSKSKISPKSDVWSLGCILYYMTYGKTPFQQIINQISKLHAIIDPNHEIEFPDIPEKDLQDVLKCCLKRDPKQRISIPELLAHPYVQIQTHPVNNGREH

SEQ ID NO: 815740 - protein, 654 aa, Homo sapiens; identical to SEQ ID NO: 815738

SEQ ID NO: 815741 - protein, 119 aa, Homo sapiens
AGPPAAVCCPPAGRVIWGPVRPPFPRSFRRRSLVSKSAGVSARVCRRASPGAPASPAGRWSTTGGRPWAALPNLRTGRATSRRQISPVAESPFPHLYNGHLNYPQNLHSGRYPVPGTWS

SEQ ID NO: 815742 - protein, 283 aa, Homo sapiens
GAQRERRALGWRLSRSRSCSRPHTAARSSSHARPLPGRPGAGHRGGDPADRARPAPAPAPTPSPLRSAAARLARRPRQSCRKMVNDRWKTMGGAAQLEDRPRDKPQRPSCGYVLCTVLLALAVLLAVAVTGAVLFLNHAHAPGTAPPPVVSTGAASANSALVTVERADSSHLSILIDPRCPDLTDSFARLESAQASVLQALTEHQAQPRLVGDQEQELLDTLADQLPRLLARASELQTECMGLRKGHGTLGQGLSALQSEQGRLIQLALCPSATRSSTCANVC

SEQ ID NO: 815743 - protein, 356 aa, Homo sapiens
MVNDRWKTMGGAAQLEDRPRDKPQRPSCGYVLCTVLLALAVLLAVAVTGAVLFLNHAHAPGTAPPPVVSTGAASANSALVTVERADSSHLSILIDPRCPDLTDSFARLESAQASVLQALTEHQAQPRLVGDQEQELLDTLADQLPRLLARASELQTECMGLRKGHGTLGQGLSALQSEQGRLIQLLSESQGHMAHLVNSVSDILDALQRDRGLGRPRNKADLQRAPARGTRPRGCATGSRPRDCLDVLLSGQQDDGVYSVFPTHYPAGFQVYCDMRTDGGGWTVFQRREDGSVNFFRGWDAYRDGFGRLTGEHWLGPLDRCTLSLALLVPVAPSPTPPHSFVNVLHPPVPGGPTLQ

SEQ ID NO: 815744 - protein, 140 aa, Homo sapiens
ALTTQAAYELHVDLEDFENGTAYARYGSFGVGLFSVDPEEDGYPLTVADYSGTAGDSLLKHSGMRFTTKDRDSDHSENNCAAFYRGAWWYRNCHTSNLNGQYLRGAHASYADGVEWSSWTGWQYSLKFSEMKIRPVREDR

SEQ ID NO: 815745 - protein, 104 aa, Homo sapiens
MRELTLLPTTATEEGINHECKLCNQMFDSPAKLLCHLIEHSFEGMGGTFKCPVCFTVFVQANKLQQHIFAVHGQEDKIYDCSQCPQKFFFQTELQNHTMSQHAQ

SEQ ID NO: 815746 - protein, 110 aa, Homo sapiens
GPSLFSLSVEEGEASDFSLAWDSSVTAAGGLEGEPECDQKTSRALEDRNSVTSQEERNEDDEDMEDESIYTCDHCQQDFESLADLTDHRAHRCPGGNAKQPQDSDRWLHG

SEQ ID NO: 815747 - protein, 1287 aa, Homo sapiens
GPSLFSLSVEEGEASDFSLAWDSSVTAAGGLEGEPECDQKTSRALEDRNSVTSQEERNEDDEDMEDESIYTCDHCQQDFESLADLTDHRAHRCPGDGDDDPQLSWVASSPSSKDVASPTQMIGDGCDLGLGEEEGGTGLPYPCQFCDKSFIRLSYLKRHEQIHSDKLPFKCTYCSRLFKHKRSRDRHIKLHTGDKKYHCHECEAAFSRSDHLKIHLKTHSSSKPFKCTVCKRGFSSTSSLQSHMQAHKKNKEHLAKSEKEAKKDDFMCDYCEDTFSQTEELEKHVLTRHPQLSEKADLQCIHCPEVFVDENTLLAHIHQAHANQKHKCPMCPEQFSSVEGVYCHLDSHRQPDSSNHSVSPDPVLGSVASMSSATPDSSASVERGSTPDSTLKPLRGQKKMRDDGQGWTKVVYSCPYCSKRDFNSLAVLEIHLKTIHADKPQQSHTCQICLDSMPTLYNLNEHVRKLHKNHAYPVMQFGNISAFHCNYCPEMFADINSLQEHIRVSHCGPNANPSDGNNAFFCNQCSMGFLTESSLTEHIQQAHCSVGSAKLESPVVQPTQSFMEVYSCPYCTNSPIFGSILKLTKHIKENHKNIPLAHSKKSKAEQSPVSSDVEVSSPKRQRLSASANSISNGEYPCNQCDLKFSNFESFQTHLKLHLELLLRKQACPQCKEDFDSQESLLQHLTVHYMTTSTHYVCESCDKQFSSVDDLQKHLLDMHTFVLYHCTLCQEVFDSKVSIQVHLAVKHSNEKKMYRCTACNWDFRKEADLQVHVKHSHLGNPAKAHKCIFCGETFSTEVELQCHITTHSKKYNCKFCSKAFHAIILLEKHLREKHCVFDAATENGTANGVPPMATKKAEPADLQGMLLKNPEAPNSHEASEDDVDASEPMYGCDICGAAYTMEVLLQNHRLRDHNIRPGEDDGSRKKAEFIKGSHKCNVCSRTFFSENGLREHLQTHRGPAKHYMCPICGERFPSLLTLTEHKVTHSKSLDTGTCRICKMPLQSEEEFIEHCQMHPDLRNSLTGFRCVVCMQTVTSTLELKIHGTFHMQKLAGSSAASSPNGQGLQKLYKCALCLKEFRSKQDLVKLDVNGLPYGLCAGCMARSANGQVGGLAPPEPADRPCAGLRCPECSVKFESAEDLESHMQVDHRDLTPETSGPRKGTQTSPVPRKKTYQCIKCQMTFENEREIQIHVANHMIEEGINHECKLCNQMFDSPAKLLCHLIEHSFEGMGGTFKCPVCFTVFVQANKLQQHIFAVHGQEDKIYDCSQCPQKFFFQTELQNHTMSQHAQ

SEQ ID NO: 815748 - protein, 1292 aa, Homo sapiens
GPSLFSLSVEEGEASDFSLAWDSSVTAAGGLEGEPECDQKTSRALEDRNSVTSQEERNEDDEDMEDESIYTCDHCQQDFESLADLTDHRAHRCPGDGDDDPQLSWVASSPSSKDVASPTQMIGDGCDLGLGEEEGGTGLPYPCQFCDKSFIRLSYLKRHEQIHSDKLPFKCTYCSRLFKHKRSRDRHIKLHTGDKKYHCHECEAAFSRSDHLKIHLKTHSSSKPFKCTVCKRGFSSTSSLQSHMQAHKKNKEHLAKSEKEAKKDDFMCDYCEDTFSQTEELEKHVLTRHPQLSEKADLQCIHCPEVFVDENTLLAHIHQAHANQKHKCPMCPEQFSSVEGVYCHLDSHRQPDSSNHSVSPDPVLGSVASMSSATPDSSASVERGSTPDSTLKPLRGQKKMRDDGQGWTKVVYSCPYCSKRDFNSLAVLEIHLKTIHADKPQQSHTCQICLDSMPTLYNLNEHVRKLHKNHAYPVMQFGNISAFHCNYCPEMFADINSLQEHIRVSHCGPNANPSDGNNAFFCNQCSMGFLTESSLTEHIQQAHCSVGSAKLESPVVQPTQSFMEVYSCPYCTNSPIFGSILKLTKHIKENHKNIPLAHSKKSKAEQSPVSSDVEVSSPKRQRLSASANSISNGEYPCNQCDLKFSNFESFQTHLKLHLELLLRKQACPQCKEDFDSQESLLQHLTVHYMTTSTHYVCESCDKQFSSVDDLQKHLLDMHTFVLYHCTLCQEVFDSKVSIQVHLAVKHSNEKKMYRCTACNWDFRKEADLQVHVKHSHLGNPAKAHKCIFCGETFSTEVELQCHITTHSKKYNCKFCSKAFHAIILLEKHLREKHCVFDAATENGTANGVPPMATKKAEPADLQGMLLKNPEAPNSHEASEDDVDASEPMYGCDICGAAYTMEVLLQNHRLRDHNIRPGEDDGSRKKAEFIKGSHKCNVCSRTFFSENGLREHLQTHRGPAKHYMCPICGERFPSLLTLTEHKVTHSKSLDTGTCRICKMPLQSEEEFIEHCQMHPDLRNSLTGFRCVVCMQTVTSTLELKIHGTFHMQKLAGSSAASSPNGQGLQKLYKCALCLKEFRSKQDLVKLDVNGLPYGLCAGCMARSANGQVGGLAPPEPADRPCAGLRCPECSVKFESAEDLESHMQVDHRDLTPETSGPRKGTQTSPVPRKKTYQCIKCQMTFENEREIQIHVANHMIEEGINHECKLCNQMFDSPAKLLCHLIEHSFEGMGGTFKCPVCFTEPHDEPARTVRDRSTGHLSAEGLPETPWGGPFEHYIQSKCHLQPRCKTLMIWP

SEQ ID NO: 815749 - protein, 1226 aa, Homo sapiens
GPSLFSLSVEEGEASDFSLAWDSSVTAAGGLEGEPECDQKTSRALEDRNSVTSQEERNEDDEDMEDESIYTCDHCQQDFESLADLTDHRAHRCPGDGDDDPQLSWVASSPSSKDVASPTQMIGDGCDLGLGEEEGGTGLPYPCQFCDKSFIRLSYLKRHEQIHSDKLPFKCTYCSRLFKHKRSRDRHIKLHTGDKKYHCHECEAAFSRSDHLKIHLKTHSSSKPFKCTVCKRGFSSTSSLQSHMQAHKKNKEHLAKSEKEAKKDDFMCDYCEDTFSQTEELEKHVLTRHPQLSEKADLQCIHCPEVFVDENTLLAHIHQAHANQKHKCPMCPEQFSSVEGVYCHLDSHRQPDSSNHSVSPDPVLGSVASMSSATPDSSASVERGSTPDSTLKPLRGQKKMRDDGQGWTKVVYSCPYCSKRDFNSLAVLEIHLKTIHADKPQQSHTCQICLDSMPTLYNLNEHVRKLHKNHAYPVMQFGNISAFHCNYCPEMFADINSLQEHIRVSHCGPNANPSDGNNAFFCNQCSMGFLTESSLTEHIQQAHCSVGSAKLESPVVQPTQSFMEVYSCPYCTNSPIFGSILKLTKHIKENHKNIPLAHSKKSKAEQSPVSSDVEVSSPKRQRLSASANSISNGEYPCNQCDLKFSNFESFQTHLKLHLELLLRKQACPQCKEDFDSQESLLQHLTVHYMTTSTHYVCESCDKQFSSVDDLQKHLLDMHTFVLYHCTLCQEVFDSKVSIQVHLAVKHSNEKKMYRCTACNWDFRKEADLQVHVKHSHLGNPAKAHKCIFCGETFSTEVELQCHITTHSKKYNCKFCSKAFHAIILLEKHLREKHCVFDAATENGTANGVPPMATKKAEPADLQGMLLKNPEAPNSHEASEDDVDASEPMYGCDICGAAYTMEVLLQNHRLRDHNIRPGEDDGSRKKAEFIKGSHKCNVCSRTFFSENGLREHLQTHRGPAKHYMCPICGERFPSLLTLTEHKVTHSKSLDTGTCRICKMPLQSEEEFIEHCQMHPDLRNSLTGFRCVVCMQTVTSTLELKIHGTFHMQKLAGSSAASSPNGQGLQKLYKCALCLKEFRSKQDLVKLDVNGLPYGLCAGCMARSANGQVGGLAPPEPADRPCAGLRCPECSVKFESAEDLESHMQVDHRDLTPETSGPRKGTQTSPVPRKKTYQCIKCQMTFENEREIQIHVANHMIEEGINHECKLCNQMFDSPAKLLCHLIEHSWP

SEQ ID NO: 815750 - protein, 1180 aa, Homo sapiens
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAVSVGQKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNVPFLVALALLSSVLVGLVLVPGLLQGPLALRNITDTGFKLLLLGLVTLNFVGAFMLESVLDQCLPACLRRLRPKRASKKRFKQLERELAEQPWPPLPAGPLR

SEQ ID NO: 815751 - protein, 971 aa, Homo sapiens
MVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNVPFLVALALLSSVLVGLVLVPGLLQGPLALRNITDTGFKLLLLGLVTLNFVGAFMLESVLDQCLPACLRRLRPKRASKKRFKQLERELAEQPWPPLPAGPLR

SEQ ID NO: 815752 - protein, 874 aa, Homo sapiens
SHLVTELTETESLWDNSTQNSWFAGGREGCGVVLTPRSPPGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNVPFLVALALLSSVLVGLVLVPGLLQGPLALRNITDTGFKLLLLGLVTLNFVGAFMLESVLDQCLPACLRRLRPKRASKKRFKQLERELAEQPWPPLPAGPLR

SEQ ID NO: 815753 - protein, 1160 aa, Homo sapiens
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAVSVGQKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNVPFLVALALLSSVLVGLVLVPGLLQGPLALRNITDTGFKLLLLGLVTLNFVGAFMLESVLDQCLPACLRRLRPKRASKKRFKQLERELAEQPWPPLPAGPLR

SEQ ID NO: 815754 - protein, 1091 aa, Homo sapiens
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAVSVGQKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKVLEEEPAADSAFGTQVLAVMRPPLWEPQLQAMRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNVPFLVALALLSSVLVGLVLVPGLLQGPLALRNITDTGFKLLLLGLVTLNFVGAFMLESVLDQCLPACLRRLRPKRASKKRFKQLERELAEQPWPPLPAGPLR

SEQ ID NO: 815755 - protein, 1202 aa, Homo sapiens
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAVSVGQKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNERARPVPPRLPAPPPAQAGLQEALQAAGTRAGRAALAAAARRPPEVVQAHGHPRHWNSLPLSHQLDPSPATPPPPPPTSLRLATVYTPPPRPPPPWGSVDYCPLPWTIPRRGGSPQLPSVLLSV

SEQ ID NO: 815756 - protein, 1141 aa, Homo sapiens
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAVSVGQKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNVPFLVALALLSSVLVGLVLVPGLLQGPLALRNITDTGFKLLLLGLVTLNFVGAFMLESVLDQCLPACLRRLRPKRASKKRFKQLERELAEQPWPPLPAGPLR

SEQ ID NO: 815757 - protein, 994 aa, Homo sapiens
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAVSVGQKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDWSWDGCGHRGRCSACPCSAACCCRWSW

SEQ ID NO: 815758 - protein, 1111 aa, Homo sapiens
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAVSVGQKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNGATAGAGGRCWRREGGALGCWGGRWERGAGRVE

SEQ ID NO: 815759 - protein, 803 aa, Homo sapiens
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAVSVGQKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATTSHIPEVGDCLHSSPETTPTLGKR

SEQ ID NO: 815760 - protein, 552 aa, Homo sapiens
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAVSVGQKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKVGPQVGLVQGSGTATGAPVRPPHPRYSLSSTHRMPGPV

SEQ ID NO: 815761 - protein, 51 aa, Homo sapiens
GPGTGAATGGAAQRARAQQPAAADGPGDRRAARGLLPDPGPAMVSRELTDH

SEQ ID NO: 815762 - protein, 461 aa, Homo sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVYDPKNEEDDMREMEEERLRMREHVMKNVDTNQDRLVTLEEFLASTQRKEFGDTGEGWETVEMHPAYTEEELRRFEEELAAREAELNAKAQRLSQETEALGRSQGRLEAQKRELQQAVLHMEQRKQQQQQQQGHKAPAAHPEGQLKFHPDTDDVPVPAPAGDQKEVDTSEKKLLERLPEVEVPQHL

SEQ ID NO: 815763 - protein, 410 aa, Homo sapiens
CWLTLEDPGSGVLRGPFLYEPVAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVYDPKNEEDDMREMEEERLRMREHVMKNVDTNQDRLVTLEEFLASTQRKEFGDTGEGWETVEMHPAYTEEELRRFEEELAAREAELNAKAQRLSQETEALGRSQGRLEAQKRELQQAVLHMEQRKQQQQQQQGHKAPAAHPEGQLKFHPDTDDVPVPAPAGDQKEVDTSEKKLLERLPEVEVPQHL

SEQ ID NO: 815764 - protein, 73 aa, Homo sapiens
GLLCLSLLPQDTGLYYHRYLQEVIDVLETDGHFREKLQAANAEDIKSGKLSRELDFVSQGQPLPESPARSDKR

SEQ ID NO: 815765 - protein, 229 aa, Homo sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPVRTPFVP

SEQ ID NO: 815766 - protein, 134 aa, Homo sapiens
RHYMLVFIMVIIVSIRLSRGITSSRKPSLIAPGSSCLLGFPSAVRDFFGSCLAQDGGSERTCPQVLDSSLSSRCTGGSSESPDLPSSSLQISTVMVSWMSRSWRHSSPRSEHLGSLGHLEGRPNQPLVSSCSPL

SEQ ID NO: 815767 - protein, 178 aa, Homo sapiens
GLVVWEAEVPDNPGADSVSRALNARARESCMTVTQACFLEPSLGSIPFSTPWSLGSGPSNGSSGVAKAWGPPFHRGRPVVTCPLITDPTSAQNFFTRDLTHPVLGPLRYLAILFPSDINSDGVLDEQELEALFTKELEKVYDPKNEEDDMREMEEERLRMREHVMKNVRWGPGGGEDG

SEQ ID NO: 815768 - protein, 461 aa, Homo sapiens; identical to SEQ ID NO: 815762

SEQ ID NO: 815769 - protein, 461 aa, Homo sapiens; identical to SEQ ID NO: 815762

SEQ ID NO: 815770 - protein, 461 aa, Homo sapiens; identical to SEQ ID NO: 815762

SEQ ID NO: 815771 - protein, 461 aa, Homo sapiens; identical to SEQ ID NO: 815762

SEQ ID NO: 815772 - protein, 461 aa, Homo sapiens; identical to SEQ ID NO: 815762

SEQ ID NO: 815773 - protein, 461 aa, Homo sapiens; identical to SEQ ID NO: 815762

SEQ ID NO: 815774 - protein, 461 aa, Homo sapiens; identical to SEQ ID NO: 815762

SEQ ID NO: 815775 - protein, 461 aa, Homo sapiens; identical to SEQ ID NO: 815762

SEQ ID NO: 815776 - protein, 461 aa, Homo sapiens; identical to SEQ ID NO: 815762

SEQ ID NO: 815777 - protein, 461 aa, Homo sapiens; identical to SEQ ID NO: 815762

SEQ ID NO: 815778 - protein, 461 aa, Homo sapiens; identical to SEQ ID NO: 815762

SEQ ID NO: 815779 - protein, 461 aa, Homo sapiens; identical to SEQ ID NO: 815762

SEQ ID NO: 815780 - protein, 250 aa, Homo sapiens
MLKEHERRRYLESLGEEQRKEAERKLEEQQRRHREHPKVNVPGSQAQLKEVWELEALFTKELEKVYDPKNEEDDMREMEEERLRMREHVMKNVDTNQDRLVTLEEFLASTQRKEFGDTGEGWETVEMHPAYTEEELRRFEEELAAREAELNAKAQRLSQETEALGRSQGRLEAQKRELQQAVLHMEQRKQQQQQQQGHKAPAAHPEGQLKFHPDTDDVPVPAPAGDQKEVDTSEKKLLERLPEVEVPQHL

SEQ ID NO: 815781 - protein, 461 aa, Homo sapiens; identical to SEQ ID NO: 815762

SEQ ID NO: 815782 - protein, 461 aa, Homo sapiens; identical to SEQ ID NO: 815762

SEQ ID NO: 815783 - protein, 164 aa, Homo sapiens
MPPSGPRGTLLLLPLLLLLLLRSTQRKEFGDTGEGWETVEMHPAYTEEELRRFEEELAAREAELNAKAQRLSQETEALGRSQGRLEAQKRELQQAVLHMEQRKQQQQQQQGHKAPAAHPEGQLKFHPDTDDVPVPAPAGDQKEVDTSEKKLLERLPEVEVPQHL

SEQ ID NO: 815784 - protein, 461 aa, Homo sapiens; identical to SEQ ID NO: 815762

SEQ ID NO: 815785 - protein, 461 aa, Homo sapiens; identical to SEQ ID NO: 815762

SEQ ID NO: 815786 - protein, 461 aa, Homo sapiens; identical to SEQ ID NO: 815762

SEQ ID NO: 815787 - protein, 102 aa, Homo sapiens
RLYALRVMGCGEGETTLPCLPLGPEEPSFCCRCCCCSCFAPCWLSPWSEGRPTRRRPLRLRVPTQACTTTGTSRRSSMYWRRMGISERSCRLPMRRTSRAGS

SEQ ID NO: 815788 - protein, 314 aa, Homo sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVYDPKNEEDDMREMEEERLRMREHVMKNLKTFPYLLWNQ

SEQ ID NO: 815789 - protein, 102 aa, Homo sapiens; identical to SEQ ID NO: 815787

SEQ ID NO: 815790 - protein, 70 aa, Homo sapiens
TLQPSLKIHNPNNNNHNNKPKTPLTTFPLQVHPDTDDVPVPAPAGDQKEVDTSEKKLLERLPEVEVPQHL

SEQ ID NO: 815791 - protein, 102 aa, Homo sapiens; identical to SEQ ID NO: 815787

SEQ ID NO: 815792 - protein, 102 aa, Homo sapiens; identical to SEQ ID NO: 815787

SEQ ID NO: 815793 - protein, 286 aa, Homo sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHAQDLPLPFVEPVMPQRQCPLHSWVPGAGDPQYSR

SEQ ID NO: 815794 - protein, 322 aa, Homo sapiens
VRNSRDALCGEGETTKAPAAHPEGQLKSTQTQTMYLSQLQPGDQKEVDTSEKKLLERLPEVEVPPASVILRDPSAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPMLGSWGGGTAWHFTHCCHPRSTCLHFHSLQVCGSSLLSSEGLAFSRVQ

SEQ ID NO: 815795 - protein, 105 aa, Homo sapiens
CRLVLAWDVIALCGEGETTLPCLPLGPEEPSFCCRCCCCSCFAPCWLSPWSEGRPTRRRPLRLRVPTQACTTTGTSRRSSMYWRRMGISERSCRLPMRRTSRAGS

SEQ ID NO: 815796 - protein, 105 aa, Homo sapiens; identical to SEQ ID NO: 815795

SEQ ID NO: 815797 - protein, 111 aa, Homo sapiens
CRLVLAWDVIALCGEGETTLPCLPLGPEEPSFCCRCCCCSCFAPCWLSPWSEGRPTRRRPLRLRVPTQACTTTGTSRRSSMYWRRMGISERSCRLPMRRTSRATAPAPRAP

SEQ ID NO: 815798 - protein, 119 aa, Homo sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHQDLGPAPQPHLEPLKTSPTHLSGLI

SEQ ID NO: 815799 - protein, 467 aa, Homo sapiens
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQAVTRPTLPDPHLSHPQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTG

SEQ ID NO: 815800 - protein, 481 aa, Homo sapiens
RQHELGLGQMRLAGGAGSMVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGPGLWWNPAPYQP

SEQ ID NO: 815801 - protein, 497 aa, Homo sapiens
RQHELGLGQMRLAGGAGSMVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQAVTRPTLPDPHLSHPQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGPGLWWNPAPYQP

SEQ ID NO: 815802 - protein, 503 aa, Homo sapiens
RQHELGLGQMRLAGGAGSMVHSSMGAPEIRMSKPLEAEKQGLDSPSEHTDTERNGPDTNHQNPQNKTSPFSVSPTGPSTKVGILSGLHLTFWGPGPCLSPPQIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGPGLWWNPAPYQP

SEQ ID NO: 815803 - protein, 451 aa, Homo sapiens
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTG

SEQ ID NO: 815804 - protein, 128 aa, Homo sapiens
MLGCPCSAPRLVWAWSQQRLRLWQPPSPASLLASPPHPLHPHPPPPPLAARRQHRPLEVQGGPRQGPNLSEGQPCLPSHSSGPCLGPLPGKRARRPVVGTQRVLRAGVTREERPKKQPTKKKKKKERN

SEQ ID NO: 815805 - protein, 367 aa, Homo sapiens
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCMWVGEWERQWEEGRTHPSSAGATQL

SEQ ID NO: 815806 - protein, 199 aa, Homo sapiens
RLVQAGVLGSGSMVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQVRLSIECTRPGQQQGLLKAG

SEQ ID NO: 815807 - protein, 481 aa, Homo sapiens; identical to SEQ ID NO: 815800

SEQ ID NO: 815808 - protein, 400 aa, Homo sapiens
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTAQTPALKAATRLSACQA

SEQ ID NO: 815809 - protein, 519 aa, Homo sapiens
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTEAQMVGLSSGLSPALMSNNPLATIQALASGGTLPLTSLDGSGNLVLGAAGAAPGSPGLVTSPLFLNHAGLPLLSTPPGVGLVSAAAAAVAASISSKSPGLSSSSSSSSSSSSSTCSETAAQTPGGPGGPEAGSKPE

SEQ ID NO: 815810 - protein, 403 aa, Homo sapiens [sequence omitted]

SEQ ID NO: 815811 - protein, 1429 aa, Homo sapiens
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSRDSEATRKNTNDAFLYIYESGGPGHSKMTEPSLQNKDSSCSESKMLEQETIVASEAGENEKHKKSFLEHSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILDSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEADSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 815812 - protein, 1453 aa, Homo sapiens
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSRDSEATRKNTNDAFLYIYESGGPGHSKMTEPSLQNKDSSCSESKMLEQETIVASEAGENEKHKKSFLEHSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILDSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEAGGNLLVLVDQHAAHERIRLEQLIIDSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 815813 - protein, 1453 aa, Homo sapiens; identical to SEQ ID NO: 815812

SEQ ID NO: 815814 - protein, 1453 aa, Homo sapiens; identical to SEQ ID NO: 815812

SEQ ID NO: 815815 - protein, 1453 aa, Homo sapiens; identical to SEQ ID NO: 815812

SEQ ID NO: 815816 - protein, 1402 aa, Homo sapiens
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSQGFRTGENEKHKKSFLEHSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILDSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEAGGNLLVLVDQHAAHERIRLEQLIIDSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 815817 - protein, 480 aa, Homo sapiens
MLNFGASLQQTAEERMEMISERPKESMYSWNKTAEKSDFEAVEALMSMSCSWKSDFKKYVENRPVTPVSDLSEEENLLPGTPDFHTIPAFCLTPPYSPSDFEPSQVSNLMAPAPSTVHFKSLSDTAKPHIAAPFKEEEKSPVSAPKLPKAQATSVIRHTADAQLCNHQTCPMKAASILNYQNNSFRRRTHLNVEAARKNIPCAAVSPNRSKCERNTVADVDEKASAALYDFSVPSSETVICRSQPAPVSPQQKSVLVSPPAVSAGGVPPMPVICQMVPLPANNPVVTTVVPSTPPSQPPAVCPPVVFMGTQVPKGAVMFVVPQPVVQSSKPPVVSPNGTRLSPIAPAPGFSPSAAKVTPQIDSSRIRSHICSHPGCGKTYFKSSHLKAHTRTHTGEKPFSCSWKGCERRFARSDELSRHRRTHTGEKKFACPMCDRRFMRSDHLTKHARRHLSAKKLPNWQMEVSKLNDIALPPTPAPTQ

SEQ ID NO: 815818 - protein, 469 aa, Homo sapiens
MEERMEMISERPKESMYSWNKTAEKSDFEAVEALMSMSCSWKSDFKKYVENRPVTPVSDLSEEENLLPGTPDFHTIPAFCLTPPYSPSDFEPSQVSNLMAPAPSTVHFKSLSDTAKPHIAAPFKEEEKSPVSAPKLPKAQATSVIRHTADAQLCNHQTCPMKAASILNYQNNSFRRRTHLNVEAARKNIPCAAVSPNRSKCERNTVADVDEKASAALYDFSVPSSETVICRSQPAPVSPQQKSVLVSPPAVSAGGVPPMPVICQMVPLPANNPVVTTVVPSTPPSQPPAVCPPVVFMGTQVPKGAVMFVVPQPVVQSSKPPVVSPNGTRLSPIAPAPGFSPSAAKVTPQIDSSRIRSHICSHPGCGKTYFKSSHLKAHTRTHTGEKPFSCSWKGCERRFARSDELSRHRRTHTGEKKFACPMCDRRFMRSDHLTKHARRHLSAKKLPNWQMEVSKLNDIALPPTPAPTQ

SEQ ID NO: 815819 - protein, 480 aa, Homo sapiens; identical to SEQ ID NO: 815817

SEQ ID NO: 815820 - protein, 480 aa, Homo sapiens; identical to SEQ ID NO: 815817

SEQ ID NO: 815821 - protein, 480 aa, Homo sapiens; identical to SEQ ID NO: 815817

SEQ ID NO: 815822 - protein, 482 aa, Homo sapiens
MLNFGASLQQTAEERMEMISERPKESMYSWNKTAEKSDFEAVEALMSMSCSWKSDFKKYVENRPVTPVSDLSEEENLLPGTPDFHTIPAFCLTPPYSPSDFEPSQVSNLMAPAPSTVHFKSLSDTAKPHIAAPFKEEEKSPVSAPKLPKAQATSVIRHTADAQLCNHQTCPMKAASILNYQNNSFRRRTHLNVEAARKNIPCAAVSPNRSKCERNTVADVDEKASAALYDFSVPSSETVICRSQPAPVSPQQKSVLVSPPAVSAGGVPPMPVICQMVPLPANNPVVTTVVPSTPPSQPPAVCPPVVFMGTQVPKGAVMFVVPQPVVQSSKPPVVSPNGTRLSPIAPAPGFSPSAAKVTPQIDSSRIRSHICSHPGCGKTYFKSSHLKAHTRTHTGEKPFSCSWKGCERRFARSDELSRHRRTHTGEKKFACPMCDRRFMRSDHLTKHARRHLSAKKLPNWQMEVSKLNDIALPPTPARQTYL

SEQ ID NO: 815823 - protein, 206 aa, Homo sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLLELE

SEQ ID NO: 815824 - protein, 111 aa, Homo sapiens
GRLLLLNSRPRRPELYFEKGEYFVEMYYRNETQHEPYPLMLPGCSPSCPLERFAELVGPVIPQDWSTECMTTNSHQGPAETAHSARRNHDIALPCGRSTCLENTVLYYHYG

SEQ ID NO: 815825 - protein, 193 aa, Homo sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQSHHRHDHRISLWLKLSLTAGPRLLPSDLWGRLLSSLSCQYP

SEQ ID NO: 815826 - protein, 201 aa, Homo sapiens
MRAAPLLLARAASLSLGFLFLLFFWLDRSVLAKELKFVTLVFRHGDRSPIDTFPTDPIKESSWPQGFGQLTQLGMEQHYELGEYIRKKKKKQKKNNLLCGAAWGPWRKFFKPILGWGARGPQLGRGPVGPRRGSQREHPGPKDKGGGILLPILKKAAGGDPGGVLVDKSPERAAGEGQTGGLITRGAPGEPKIKPATGGGG

SEQ ID NO: 815827 - protein, 206 aa, Homo sapiens; identical to SEQ ID NO: 815823

SEQ ID NO: 815828 - protein, 206 aa, Homo sapiens; identical to SEQ ID NO: 815823

SEQ ID NO: 815829 - protein, 206 aa, Homo sapiens; identical to SEQ ID NO: 815823

SEQ ID NO: 815830 - protein, 206 aa, Homo sapiens; identical to SEQ ID NO: 815823

SEQ ID NO: 815831 - protein, 206 aa, Homo sapiens; identical to SEQ ID NO: 815823

SEQ ID NO: 815832 - protein, 206 aa, Homo sapiens; identical to SEQ ID NO: 815823

SEQ ID NO: 815833 - protein, 206 aa, Homo sapiens; identical to SEQ ID NO: 815823

SEQ ID NO: 815834 - protein, 206 aa, Homo sapiens; identical to SEQ ID NO: 815823

SEQ ID NO: 815835 - protein, 206 aa, Homo sapiens; identical to SEQ ID NO: 815823

SEQ ID NO: 815836 - protein, 217 aa, Homo sapiens
MIGPHHRIARHRKPMGQPMTPTKPQPTIHIHRLVRYSRVHANGKIPSSAPSVSISNSSPVTIDTGQPLLTDYLMATGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLLELE

SEQ ID NO: 815837 - protein, 155 aa, Homo sapiens
MTKLRECAELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQGTEDSTD

SEQ ID NO: 815838 - protein, 268 aa, Homo sapiens
MSGDILGYTSGRLGMLLASSGQRPGYCETSYNAQESSLQQTIVWPKISIMLKLRNLCRNFSFSVCVSGFYSYLGKTFRITWPGPFGIGVKSTTLYIVESVHNFTLPSWATEDTMTKLRECAELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQGTEDSTD

SEQ ID NO: 815839 - protein, 137 aa, Homo sapiens
MRAAPLLLARAASLSLGFLFLLFFWLDRSVLAKELKFVTLVFRHGDRSPIDTFPSILGVRGGQITVTELYFEKGEYFVEMYYRNETQHEPYPLMLPGCSPSCPLERFAELVGPVIPQDWSTECMTTNSHQGTEDSTD

SEQ ID NO: 815840 - protein, 206 aa, Homo sapiens; identical to SEQ ID NO: 815823

SEQ ID NO: 815841 - protein, 111 aa, Homo sapiens; identical to SEQ ID NO: 815824

SEQ ID NO: 815842 - protein, 91 aa, Homo sapiens
CCRVLYPSTCAPDLVDTVDTVNPLILIDLLLIKPETIGPGKRPAHDHSSSAQLSAYTVISFNTSYVSHGTWSDVCCDLFHWIGQALFHIAS

SEQ ID NO: 815843 - protein, 685 aa, Homo sapiens
ARQELLSPSLCQDRRKYVPSLTMSWLSSSQGVVLTAYHPSGKDQAVGNSHAKAGEEATSSRRYGQYTMNQESTTIKVMEKPPFDRSISQDSLDELSMEDYWIELENIKKSSENSQEDQEVVVVKEPDEGELEEEWLKEAGLSNLFGESAGDPQESIVFLSTLTRTQAAAVQKRVETVSQTLRKKNKQYQIPDVRDIFAQQRESKETAPGGTESQSLRTNENKYQGRDDEASNLVGEEKLIPPEETPAPETDINLEVSFAEQALNQKESSKEKIQKSKGDDATLPSFRLPKDKTGTTRIGDLAPQDMKKVCHLALIELTALYDVLGIELKQQKAVKIKTKDSGLFCVPLTALLEQDQRKVPGMRIPLIFQKLISRIEERGLETEGLLRIPGAAIRIKNLCQELEAKFYEGTFNWESVKQHDAASLLKLFIRELPQPLLSVEYLKAFQAVQNLPTKKQQLQALNLLVILLPDANRDTLKALLEFLQRVIDNKEKNKMTVMNVAMVMAPNLFMCHALGLKSSEQREFVMAAGTANTMHLLIKYQKLLWTIPKFIVNQVRKQNTENHKKDKRAMKKLLKKMAYDREKYEKQDKSTNDADVPQGVIRVQAPHLSKVSMAIQLTEELKASDVLARFLSQESGVAQTLKKGEVFLYEIGGNIGERCLDDDTYMKDLYQLNPNAEWVIKSKPL

SEQ ID NO: 815844 - protein, 685 aa, Homo sapiens; identical to SEQ ID NO: 815843

SEQ ID NO: 815845 - protein, 685 aa, Homo sapiens; identical to SEQ ID NO: 815843

SEQ ID NO: 815846 - protein, 677 aa, Homo sapiens
ARQELLSPSLCQDRRKYVPSLTMSWLSSSQGVVLTAYHPSGKDQAVGNSHAKAGEEATSSRRYGQYTMNQESTTIKVMEKPPFDRSISQDSLDELSMEDYWIELENIKKSSENSQEDQEVVVVKEPDEGELEEEWLKEAGLSNLFGESAGDPQESIVFLSTLTRTQAAAVQKRVETVSQTLRKKNKQYQIPDVRDIFAQQRESKETAPGGTESQSLRTNENKYQGRDDEASNLVGEEKLIPPEETPAPETDINLEVSFAEQALNQKESSKEKIQKSKGDDATLPSFRLPKDKTGTTRIGDLAPQDMKKVCHLALIELTALYDVLGIELKQQKAVKIKTKDSGLFCVPLTALLEQDQRKVPGMRIPLIFQKLISRIEERGLETEGLLRIPGAAIRIKNLCQELEAKFYEGTFNWESVKQHDAASLLKLFIRELPQPLLSVEYLKAFQAVQNLPTKKQQLQALNLLVILLPDANRDTLKALLEFLQRVIDNKEKNKMTVMNVAMVMAPNLFMCHALGLKSSEQREFVMAAGTANTMHLLIKYQKLLWTIPKFIVNQVRKQNTENHKKDKRAMKKLLKKMAYDREKYEKQDKSTNDADVPQGVIRVQAPHLSKVSMAIQLTEELKASDVLARFLSQERGVAQTLKKGEVFCVKLAGIMGGRCLMMNLHEGFLSVTQCGWV

SEQ ID NO: 815847 - protein, 617 aa, Homo sapiens
MAEAKTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLSEEDWMRIILEALRQAENEPQSAPKENKPYALNSEKNFPMDMSDDYETQQWPERKLKHMQFPPMYEENSRDNPFKRTNEIVEEQYTPQSLATLESVFQELGKLTGPNNQKRERMDEEQKLYTDDEDDIYKANNIAYEDVVGGEDWNPVEEKIESQTQEEVRDSKENIEKNEQINDEMKRSGQLGIQEEDLRKESKDQLSDDVSKVIAYLKRLVNAAGSGRLQNGQNGERATRLFEKPLDSQSIYQLIEISRNLQIPPEDLIEMLKTGEKPNGSVEPERELDLPVDLDDISEADLDHPDLFQNRMLSKSGYPKTPGRAGTEALPDGLSVEDILNLLGMESAANQKTSYFPNPYNQEKVLPRLPYGAGRSRSNQLPKAAWIPHVENRQMAYENLNDKDQELGEYLARMLVKYPEIINSNQVKRVPGQGSSEDDLQEEEQIEQAIKEHLNQGSSQETDKLAPVSKRFPVGPPKNDDTPNRQYWDEDLLMKVLEYLNQEKAEKGREHIAKRAMENM

SEQ ID NO: 815848 - protein, 644 aa, Homo sapiens
RVLLYLQHYVAAAFSSPPCPFARNLSNMAEAKTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLSEEDWMRIILEALRQAENEPQSAPKENKPYALNSEKNFPMDMSDDYETQQWPERKLKHMQFPPMYEENSRDNPFKRTNEIVEEQYTPQSLATLESVFQELGKLTGPNNQKRERMDEEQKLYTDDEDDIYKANNIAYEDVVGGEDWNPVEEKIESQTQEEVRDSKENIEKNEQINDEMKRSGQLGIQEEDLRKESKDQLSDDVSKVIAYLKRLVNAAGSGRLQNGQNGERATRLFEKPLDSQSIYQLIEISRNLQIPPEDLIEMLKTGEKPNGSVEPERELDLPVDLDDISEADLDHPDLFQNRMLSKSGYPKTPGRAGTEALPDGLSVEDILNLLGMESAANQKTSYFPNPYNQEKVLPRLPYGAGRSRSNQLPKAAWIPHVENRQMAYENLNDKDQELGEYLARMLVKYPEIINSNQVKRVPGQGSSEDDLQEEEQIEQAIKEHLNQGSSQETDKLAPVSKRFPVGPPKNDDTPNRQYWDEDLLMKVLEYLNQEKAEKGREHIAKRAMENM

SEQ ID NO: 815849 - protein, 615 aa, Homo sapiens
MRPTHWLGAALSLIPLIFLISGAEAASFQRNQLLQKEPDLRLENVQKFPSPEMIRALEYIENLRQQAHKEESSPDYNPYQGVSVPLQQKENGDESHLPERDSLSEEDWMRIILEALRQAENEPQSAPKENKPYALNSEKNFPMDMSDDYETQQWPERKLKHMQFPPMYEENSRDNPFKRTNEIVEEQYTPQSLATLESVFQELGKLTGPNNQKRERMDEEQKLYTDDEDDIYKANNIAYEDVVGGEDWNPVEEKIESQTQEEVRDSKENIEKNEQINDEMKRSGQLGIQEEDLRKESKDQLSDDVSKVIAYLKRLVNAAGSGRLQNGQNGERATRLFEKPLDSQSIYQLIEISRNLQIPPEDLIEMLKTGEKPNGSVEPERELDLPVDLDDISEADLDHPDLFQNRMLSKSGYPKTPGRAGTEALPDGLSVEDILNLLGMESAANQKTSYFPNPYNQEKVLPRLPYGAGRSRSNQLPKAAWIPHVENRQMAYENLNDKDQELGEYLARMLVKYPEIINSNQVKRVPGQGSSEDDLQEEEQIEQAIKEHLNQGSSQETDKLAPVSKRFPVGPPKNDDTPNRQYWDEDLLMKVLEYLNQEKAEKGREHIAKRAMENM

SEQ ID NO: 815850 - protein, 454 aa, Homo sapiens
MQFPPMYEENSRDNPFKRTNEIVEEQYTPQSLATLESVFQELGKLTGPNNQKRERMDEEQKLYTDDEDDIYKANNIAYEDVVGGEDWNPVEEKIESQTQEEVRDSKENIEKNEQINDEMKRSGQLGIQEEDLRKESKDQLSDDVSKVIAYLKRLVNAAGSGRLQNGQNGERATRLFEKPLDSQSIYQLIEISRNLQIPPEDLIEMLKTGEKPNGSVEPERELDLPVDLDDISEADLDHPDLFQNRMLSKSGYPKTPGRAGTEALPDGLSVEDILNLLGMESAANQKTSYFPNPYNQEKVLPRLPYGAGRSRSNQLPKAAWIPHVENRQMAYENLNDKDQELGEYLARMLVKYPEIINSNQVKRVPGQGSSEDDLQEEEQIEQAIKEHLNQGSSQETDKLAPVSKRFPVGPPKNDDTPNRQYWDEDLLMKVLEYLNQEKAEKGREHIAKRAMENM

SEQ ID NO: 815851 - protein, 399 aa, Homo sapiens
MDEEQKLYTDDEDDIYKANNIAYEDVVGGEDWNPVEEKIESQTQEEVRDSKENIEKNEQINDEMKRSGQLGIQEEDLRKESKDQLSDDVSKVIAYLKRLVNAAGSGRLQNGQNGERATRLFEKPLDSQSIYQLIEISRNLQIPPEDLIEMLKTGEKPNGSVEPERELDLPVDLDDISEADLDHPDLFQNRMLSKSGYPKTPGRAGTEALPDGLSVEDILNLLGMESAANQKTSYFPNPYNQEKVLPRLPYGAGRSRSNQLPKAAWIPHVENRQMAYENLNDKDQELGEYLARMLVKYPEIINSNQVKRVPGQGSSEDDLQEEEQIEQAIKEHLNQGSSQETDKLAPVSKRFPVGPPKNDDTPNRQYWDEDLLMKVLEYLNQEKAEKGREHIAKRAMENM

SEQ ID NO: 815852 - protein, 1494 aa, Homo sapiens
MNGGKECDGGDKEGGLPAIQVPVGWQRRVDQNGVLYVSPSGSLLSCLEQVKTYLLTDGTCKCGLECPLILPKVFNFDPGAAVKQRTAEDVKADEDVTKLCIHKRKIIAVATLHKSMEAPHPSLVLTSPGGGTNATPVVPSRAATPRSVRNKSHEGITNSVMPECKNPFKLMIGSSNAMGRLYVQELPGSQQQELHPVYPRQRLGSSEHGQKSPFRGSHGGLPSPASSGSQIYGDGSISPRTDPLGSPDVFTRSNPGFHGAPNSSPIHLNRTPLSPPSVMLHGSPVQSSCAMAGRTNIPLSPTLTTKSPVMKKPMCNFSTNMEIPRAMFHHKPPQGPPPPPPPSCALQKKPLTSEKDPLGILDPIPSKPVNQNPVIINPTSFHSNVHSQVPMMNVSMPPAVVPLPSNLPLPTVKPGHMNHGSHVQRVQHSASTSLSPSPVTSPVHMMGTGIGRIEASPQRSRSSSTSSDHGNFMMPPVGPQATSSGIKVPPRSPRSTIGSPRPSMPSSPSTKSDGHHQYKDIPNPLIAGISNVLNTPSSAAFPTASAGSSSVKSQPGLLGMPLNQILNQHNAASFPASSLLSAAAKAQLANQNKLAGNNSSSSSNSGAVAGSGNTEGHSTLNTMFPPTANMLLPTGEGQSGRAALRDKLMSQQKDALRKRKQPPTTVLSLLRQSQMDSSAVPKPGPDLLRKQGQGSFPISSMSQLLQSMSCQSSHLSSNSTPGCGASNTALPCSANQLHFTDPSMNSSVLQNIPLRGEAVHCHNANTNFVHSNSPVPNHHLAGLINQIQASGNCGMLSQSGMALGNSLHPNPPQSRISTSSTPVIPNSIVSSYNQTSSEAGGSGPSSSIAIAGTNHPAITKTTSVLQDGVIVTTAAGNPLQSQLPIGSDFPFVGQEHALHFPSNSTSNNHLPHPLNPSLLSSLPISLPVNQQHLLNQNLLNILQPSAGEGDMSSINNTLSNHQLTHLQSLLNNNQMFPPNQQQQQLLQGYQNLQAFQGQSTIPCPANNNPMACLFQNFQVRMQEDAALLNKRISTQPGLTALPENPNTTLPPFQDTPCELQPRIDPSLGQQVKDGLVVGGPGDASVDAIYKAVVDAASKGMQVVITTAVNSTTQISPIPALSAMSAFTASIGDPLNLSSAVSAVIHGRNMGGVDHDGRLRNSRGARLPKNLDHGKNVNEGDGFEYFKSASCHTSKKQWDGEQSPRGERNRWKYEEFLDHPGHIHSSPCHERPNNVSTLPFLPGEQHPILLPPRNCPGDKILEENFRYNNYKRTMMSFKERLENTVERCAHINGNRPRQSRGFGELLSTAKQDLVLEEQSPSSSNSLENSLVKDYIHYNGDFNAKSVNGCVPSPSDAKSISSEDDLRNPDSPSSNELIHYRPRTFNVGDLVWGQIKGLTSWPGKLVREDDVHNSCQQSPEEGKVEPEKLKTLTEGLEAYSRVRKRNRKSGKLNNHLEAAIHEAMSELDKMSGTVHQIPQGDRQMRPPKPKRRKISR

SEQ ID NO: 815853 - protein, 130 aa, Homo sapiens
RTPMPITSQDLVLEEQSPSSSNSLENSLVKDYIHYNGDFNAKSVNGCVPSPSDAKSISSEDDLRNPDSPSSNELIHYRPRTFNVGDLVWGQIKGLTSWPGKLVREDDVHNSCQQSPEEGKVYQSLSIVKY

SEQ ID NO: 815854 - protein, 851 aa, Homo sapiens
MNGGKECDGGDKEGGLPAIQVPVGWQRRVDQNGVLYVSPSGSLLSCLEQVKTYLLTDGTCKCGLECPLILPKVFNFDPGAAVKQRTAEDVKADEDVTKLCIHKRKIIAVATLHKSMEAPHPSLVLTSPGGGTNATPVVPSRAATPRSVRNKSHEGITNSVMPECKNPFKLMIGSSNAMGRLYVQELPGSQQQELHPVYPRQRLGSSEHGQKSPFRGSHGGLPSPASSGSQIYGDGSISPRTDPLGSPDVFTRSNPGFHGAPNSSPIHLNRTPLSPPSVMLHGSPVQSSCAMAGRTNIPLSPTLTTKSPVMKKPMCNFSTNMEIPRAMFHHKPPQGPPPPPPPSCALQKKPLTSEKDPLGILDPIPSKPVNQNPVIINPTSFHSNVHSQVPMMNVSMPPAVVPLPSNLPLPTVKPGHMNHGSHVQRVQHSASTSLSPSPVTSPVHMMGTGIGRIEASPQRSRSSSTSSDHGNFMMPPVGPQATSSGIKVPPRSPRSTIGSPRPSMPSSPSTKSDGHHQYKDIPNPLIAGISNVLNTPSSAAFPTASAGSSSVKSQPGLLGMPLNQILNQHNAASFPASSLLSAAAKAQLANQNKLAGNNSSSSSNSGAVAGSGNTEGHSTLNTMFPPTANMLLPTGEGQSGRAALRDKLMSQQKDALRKRKQPPTTVLSLLRQSQMDSSAVPKPGPDLLRKQGQGSFPISSMSQLLQSMSCQSSHLSSNSTPGCGASNTALPCSANQLHFTDPSMNSSVLQNIPLRGEAVHCHNANTNFVHSNSPVPNHHLAGLINQIQASGNCGMLSQSGMALGNSLHPNPPQSRISTSSTPVIPNSIVSSYNQTSSEAGMVLLEKSTQRY

SEQ ID NO: 815855 - protein, 282 aa, Homo sapiens
MSCGRPPPDVDGMITLKVDNLTYRTSPDSLRRVFEKYGRVGDVYIPREPHTKAPRGFAFVRFHDRRDAQDAEAAMDGAELDGRELRVQVARYGRRDLPRSRQGEPRGRSRGGGYGRRSRSYGRRSRSPRRRHRSRSRGPSCSRSRSRSRYRGSRYSRSPYSRSPYSRSRYSRSPYSRSRYRESRYGGSHYSSSGYSNSRYSRYHSSRSHSKSGSSTSSRSASTSKSSSARRSKSSSVSRSRSRSRSSSMTRSPPRVSKRKSKSRSRSKRPPKSPEEEGQMSS

SEQ ID NO: 815856 - protein, 282 aa, Homo sapiens; identical to SEQ ID NO: 815855

SEQ ID NO: 815857 - protein, 282 aa, Homo sapiens; identical to SEQ ID NO: 815855

SEQ ID NO: 815858 - protein, 282 aa, Homo sapiens; identical to SEQ ID NO: 815855

SEQ ID NO: 815859 - protein, 282 aa, Homo sapiens; identical to SEQ ID NO: 815855

SEQ ID NO: 815860 - protein, 282 aa, Homo sapiens; identical to SEQ ID NO: 815855

SEQ ID NO: 815861 - protein, 282 aa, Homo sapiens; identical to SEQ ID NO: 815855

SEQ ID NO: 815862 - protein, 282 aa, Homo sapiens; identical to SEQ ID NO: 815855

SEQ ID NO: 815863 - protein, 185 aa, Homo sapiens
MAAGTCPAAARESHAAGPEAAATDGGAAATPRRRHRSRSRGPSCSRSRSRSRYRGSRYSRSPYSRSPYSRSRYSRSPYSRSRYRESRYGGSHYSSSGYSNSRYSRYHSSRSHSKSGSSTSSRSASTSKSSSARRSKSSSVSRSRSRSRSSSMTRSPPRVSKRKSKSRSRSKRPPKSPEEEGQMSS

SEQ ID NO: 815864 - protein, 262 aa, Homo sapiens
MSCGRPPPDVDGMITLKVDNLTYRTSPDSLRRVFEKYGRVGDVYIPREPHTKAPRGFAFVRFHDRRDAQDAEAAMDGAELDGRELRVQVARYGRRDLPRSRQGEPRGRSRGGGYGRRSRSYGRRSRSPRRRHRSRSRGPSCSRSRSRSRYRGSRYSRSPYSRSPYSRSRYSRSPYSRSRYRESRYGGSHYSSSGYSNSRYSRYHSSRSHSKSGSSTSSRSASTSKSSSARNPSQGRDPRGPPSLLKRKDRCPLKKMMHQEAT

SEQ ID NO: 815865 - protein, 282 aa, Homo sapiens; identical to SEQ ID NO: 815855

SEQ ID NO: 815866 - protein, 282 aa, Homo sapiens; identical to SEQ ID NO: 815855

SEQ ID NO: 815867 - protein, 160 aa, Homo sapiens
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVANDFCHDILFYLYCKLCIIKSSFKENYLVQ

SEQ ID NO: 815868 - protein, 843 aa, Homo sapiens
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLTSDIYLEYVRSGGENTAYMSNGGLGSLKVVCGYLPTLNEEEEWTCADFKCKLSPTVVGLSSKTLRATASVRSTETVDSGYRSFKRSDPVNPYHIGSGYVFAPATSANDSEISSDALTDDSMSMTDSSVDGIPPYRVGSKKQLQREMHRSVKANGQVSLPHFPRTHRLPKEMTPVEPATFAAELISRLEKLKLELESRHSLEERLQQIREDEEREGSELTLNSREGAPTQHPLSLLPSGSYEEDPQTILDDHLSRVLKTPGCQSPGVGRYSPRSRSPDHHHHHHSQYHSLLPPGGKLPPAAASPGACPLLGGKGFVTKQTTKHVHHHYIHHHAVPKTKEEIEAEATQRVHCFCPGGSEYYCYSKCKSHSKAPETMPSEQFGGSRGSTLPKRNGKGTEPGLALPAREGGAPGGAGALQLPREEGDRSQDVWQWMLESERQSKPKPHSAQSTKKAYPLESARSSPGERASRHHLWGGNSGHPRTTPRAHLFTQDPAMPPLTPPNTLAQLEEACRRLAEVSKPPKQRCCVASQQRDRNHSATVQTGATPFSNPSLAPEDHKEPKKLAGVHALQASELVVTYFFCGEEIPYRRMLKAQSLTLGHFKEQLSKKGNYRYYFKKASDEFACGAVFEEIWEDETVLPMYEGRILGKVERID

SEQ ID NO: 815869 - protein, 843 aa, Homo sapiens; identical to SEQ ID NO: 815868

SEQ ID NO: 815870 - protein, 843 aa, Homo sapiens; identical to SEQ ID NO: 815868

SEQ ID NO: 815871 - protein, 778 aa, Homo sapiens
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLTSDIYLEYVRSGGENTAYMSNGGLGSLKVVCGYLPTLNEEEEWTCADFKCKLSPTVVGLSSKTLRATASVRSTETVDSGYRSFKRSDPVNPYHIGSGYVFAPATSANDSEISSDALTDDSMSMTDSSVDGIPPYRVGSKKQLQREMHRSVKANGQVSLPHFPRTHRLPKEMTPVEPATFAAELISRLEKLKLELESRHSLEERLQQIREDEEREGSELTLNSREGAPTQHPLSLLPSGSYEEDPQTILDDHLSRVLKTPGCQSPGVGRYSPRSRSPDHHHHHHSQYHSLLPPGGKLPPAAASPGACPLLGGKGFVTKQTTKHVHHHYIHHHAVPKTKEEIEAEATQRVHCFCPGGSEYYCYSKCKSHSKAPETMPSEQFGAQSTKKAYPLESARSSPGERASRHHLWGGNSGHPRTTPRAHLFTQDPAMPPLTPPNTLAQLEEACRRLAEVSKPPKQRCCVASQQRDRNHSATVQTGATPFSNPSLAPEDHKEPKKLAGVHALQASELVVTYFFCGEEIPYRRMLKAQSLTLGHFKEQLSKKGNYRYYFKKASDEFACGAVFEEIWEDETVLPMYEGRILGKVERID

SEQ ID NO: 815872 - protein, 144 aa, Homo sapiens [sequence omitted]

SEQ ID NO: 815873 - protein, 211 aa, Homo sapiens
LQIQRPVVKTSMEQLAQELQGLAQAQDNSVLGQRLQEEAQGLRNLHQEKVVPQQSLVAKLNLSVRALESSAPNLQLETSDVLANVTYLKGELPAWAARILRNVSECFLAREMGYFSQYVAWVREEVTQRIATCQPLSGALDNSRVILCDMMADPWNAFWFCLAWCTFFLIPSIIFAVKTSKYFRPIRKRLSSTSSEETQLFHIPRVTSLKL

SEQ ID NO: 815874 - protein, 131 aa, Homo sapiens
LSRGSLWLLLERALQPERGLRTVSECFLAREMGYFSQYVAWVREEVTQRIATCQPLSGALDNSRVILCDMMADPWNAFWFCLAWCTFFLIPSIIFAVKTSKYFRPIRKRLSSTSSEETQLFHIPRVTSLKL

SEQ ID NO: 815875 - protein, 211 aa, Homo sapiens; identical to SEQ ID NO: 815873

SEQ ID NO: 815876 - protein, 211 aa, Homo sapiens; identical to SEQ ID NO: 815873

SEQ ID NO: 815877 - protein, 207 aa, Homo sapiens
MAAGCSEAPRPAAASDGSLVGQAGVLPCLELPTYAAACALVNSRYSCLVAGPHQRHIALSPRYLNRKRTGIREQLDAELLRYSESLLGVPIAYDNIKVVGELGDIYDDQGHIHLNIEADFVIFCPEPGQKLMGIVNKVSSSHIGCLVHGCFNASIPKPEQLSAEQWQTMEINMGDELEFEVFRLDSDAAGVFCIRGKLNITSYIQAL

SEQ ID NO: 815878 - protein, 347 aa, Homo sapiens
RAVGTLTSSMAAGCSEAPRPAAASDGSLVGQAGVLPCLELPTYAAACALVNSRYSCLVAGPHQRHIALSPRYLNRKRTGIREQLDAELLRYSESLLGVPIAYDNIKVVGELGDIYDDQGHIHLNIEADFVIFCPEPGQKLMGIVNKVSSSHIGCLVHGCFNASIPKPEQLSAEQWQTMEINMGDELEFEVFRLDSDAAGVFCIRGKLNITSLQFKRSEVSEEVTENGTEEAAKKPKKKKKKKDPETYEVDSGTTKLADDADDTPMEESALQNTNNANGIWEEEPKKKKKKKKHQEVQDQDPVFQGSDSSGYQSDHKKKKKKRKHSEEAEFTPPLKCSPKRKGKSNFL

SEQ ID NO: 815879 - protein, 347 aa, Homo sapiens; identical to SEQ ID NO: 815878

SEQ ID NO: 815880 - protein, 170 aa, Homo sapiens
MEINMGDELEFEVFRLDSDAAGVFCIRGKLNITSLQFKRSEVSEEVTENGTEEAAKKPKKKKKKKDPETYEVDSGTTKLADDADDTPMEESALQNTNNANGIWEEEPKKKKKKKKHQEVQDQDPVFQGSDSSGYQSDHKKKKKKRKHSEEAEFTPPLKCSPKRKGKSNFL

SEQ ID NO: 815881 - protein, 217 aa, Homo sapiens
MAAGCSEAPRPAAASDGSLVGQAGVLPCLELPTYAAACALVNSRYSCLVAGPHQRHIALSPRYLNRKRTGIREQLDAELLRYSESLLGVPIAYDNIKVVGELGDIYDDQGHIHLNIEADFVIFCPEPGQKLMGIVNKVSSSHIGCLVHGCFNASIPKPEQLSAEQWQTMEINMGDELEFEFLKKLQKMALRKLLKNLKRRKRRKTQRHMKWTVVPQS

SEQ ID NO: 815882 - protein, 347 aa, Homo sapiens; identical to SEQ ID NO: 815878

SEQ ID NO: 815883 - protein, 347 aa, Homo sapiens; identical to SEQ ID NO: 815878

SEQ ID NO: 815884 - protein, 313 aa, Homo sapiens
MKLTDSVLRSFRVAKVFRENSDKINCFDFSPNGETVISSSDDDSIVLYDCQEGKPKRTLYSKKYGVDLIRYTHAANTVVYSSNKIDDTIRYLSLHDNKYIRYFPGHSKRVVALSMSPVDDTFISGSLDKTIRLWDLRSPNCQGLMHLQGKPVCSFDPEGLIFAAGVNSEMVKLYDLRSFDKGPFATFKMQYDRTCEWTGLKFSNDGKLILISTNGSFIRLIDAFKGVVMHTFGGYANSKAVTLEASFTPDSQFIMIGSEDGKIHVWNGESGIKVAVLDGKHTGPITCLQFNPKFMTFASACSNMAFWLPTIDD

SEQ ID NO: 815885 - protein, 279 aa, Homo sapiens
ISYSGASYDLPERWQSTDNPVTVKKYGVDLIKYPHVNEHSCIGLLTNIDDTILLLSLSDEINTTLMIVFPDIPIAVVALSMSPVDDTFISGSLDKTIRLWDLRSPNCQGLMHLQGKPVCSFDPEGLIFAAGVNSEMVKLYDLRSFDKGPFATFKMQYDRTCEWTGLKFSNDGKLILISTNGSFIRLIDAFKGVVMHTFGGYANSKAVTLEASFTPDSQFIMIGSEDGKIHVWNGESGIKVAVLDGKHTGPITCLQFNPKFMTFASACSNMAFWLPTIDD

SEQ ID NO: 815886 - protein, 313 aa, Homo sapiens; identical to SEQ ID NO: 815884

SEQ ID NO: 815887 - protein, 313 aa, Homo sapiens; identical to SEQ ID NO: 815884

SEQ ID NO: 815888 - protein, 313 aa, Homo sapiens; identical to SEQ ID NO: 815884

SEQ ID NO: 815889 - protein, 313 aa, Homo sapiens; identical to SEQ ID NO: 815884

SEQ ID NO: 815890 - protein, 313 aa, Homo sapiens; identical to SEQ ID NO: 815884

SEQ ID NO: 815891 - protein, 313 aa, Homo sapiens; identical to SEQ ID NO: 815884

SEQ ID NO: 815892 - protein, 313 aa, Homo sapiens; identical to SEQ ID NO: 815884

SEQ ID NO: 815893 - protein, 313 aa, Homo sapiens; identical to SEQ ID NO: 815884

SEQ ID NO: 815894 - protein, 313 aa, Homo sapiens; identical to SEQ ID NO: 815884

SEQ ID NO: 815895 - protein, 313 aa, Homo sapiens; identical to SEQ ID NO: 815884

SEQ ID NO: 815896 - protein, 313 aa, Homo sapiens; identical to SEQ ID NO: 815884

SEQ ID NO: 815897 - protein, 313 aa, Homo sapiens; identical to SEQ ID NO: 815884

SEQ ID NO: 815898 - protein, 235 aa, Homo sapiens
MKLTDSVLRSFRVAKVFRENSDKINCFDFSPNGETVISSSDDDSIVLYDCQEGKPKRTLYSKKYGVDLIRYTHAANTVVYSSNKIDDTIRYLSLHDNKYIRYFPGHSKRVVALSMSPVDDTFISGSLDKTIRLWDLRSPNCQGLMHLQGKPVCSFDPEGLIFAAGVNSEMVKLYDLRSFDKGPFATFKMQYDRTCEWTGLKFSNDGKLILISTNGSFIRLIDAFKGVVMHTFGRC

SEQ ID NO: 815899 - protein, 151 aa, Homo sapiens
MKLTDSVLRSFRVAKVFRENSDKINCFDFSPNGETVISSSDDDSIVLYDCQEGKPKRTLYSKKYGVDLIRYTHAANTVVYSSNKIDDTIRYLSLHDNKYIRYFPGHSKRVVALSMSPVDDTFISGSLDKTIRLWDLRSPNCQVMVPHSYTF

SEQ ID NO: 815900 - protein, 343 aa, Homo sapiens [sequence omitted]

SEQ ID NO: 815901 - protein, 343 aa, Homo sapiens [sequence omitted]

SEQ ID NO: 815902 - protein, 343 aa, Homo sapiens [sequence omitted]

SEQ ID NO: 815903 - protein, 343 aa, Homo sapiens [sequence omitted]

SEQ ID NO: 815904 - protein, 343 aa, Homo sapiens [sequence omitted]

SEQ ID NO: 815905 - protein, 329 aa, Homo sapiens
MCTRAPGGLSLHDYKLLKPSLAVNLADPYRSLKAPGARGPGPEGGGGGSYFSGQGSDTGASLKLASSELERLIVPNSNGVITTTPTPPGQYFYPRGGGSGGGAGGAGGGVTEEQEGFADGFVKALDDLHKMNHVTPPNVSLGATGGPPAGPGGVYAGPEPPPVYTNLSSYSPASASSGGAGAAVGTGSSYPTTTISYLPHAPPFAGGHPAQLGLGRGASTFKEEPQTVPEARSRDATPPVSPINMEDQERIKVERKRLRNRLAATKCRKRKLERIARLEDKVKTLKAENAGLSSTAGLLREQVAQLKQKVMTHVSNGCQLLLGVKGHAF

SEQ ID NO: 815906 - protein, 343 aa, Homo sapiens [sequence omitted]

SEQ ID NO: 815907 - protein, 343 aa, Homo sapiens [sequence omitted]

SEQ ID NO: 815908 - protein, 343 aa, Homo sapiens [sequence omitted]

SEQ ID NO: 815909 - protein, 343 aa, Homo sapiens [sequence omitted]

SEQ ID NO: 815910 - protein, 343 aa, Homo sapiens [sequence omitted]

SEQ ID NO: 815911 - protein, 343 aa, Homo sapiens [sequence omitted]

SEQ ID NO: 815912 - protein, 343 aa, Homo sapiens [sequence omitted]

SEQ ID NO: 815913 - protein, 74 aa, Homo sapiens
KQGYETMISEGRDSGTLGLWARLEDKVKTLKAENAGLSSTAGLLREQVAQLKQKVMTHVSNGCQLLLGVKGHAF

SEQ ID NO: 815914 - protein, 243 aa, Homo sapiens
MEQPFYHDDSYTATGYGRAPGGLSLHDYKLLKPSLAVNLADPYRSLKAPGARGPGPEGGGGGSYFSGQGSDTGASLKLASSELERLIVPNSNGVITTTPTPPGQYFYPRGGGSGGGAGGAGGGVTEEQEGFADGFVKALDDLHKMNHVTPPNVSLGATGGPPAGPGGVYAGPEPPPVYTNLSSYSPASASSGGAGAAVGTGSSYPTTTISYLPHAPPFAGRGMGWRGSTSGDGRRRQTEPPRD

SEQ ID NO: 815915 - protein, 200 aa, Homo sapiens
LEHVSLACWPMGWDLRAARPASEPAGSWELGETTPGKLSRQRGRRGLGKPDRAFAHSCRLAATRPRQPPRTRDQAPSPVTAAESSPLAAARPGAAPQGTLPRPPGPPGCALKWNSPSTTTFTSPPFHFFLYVFFLLETDSIHIEYNIFVYLTGRGRGGDSRRSWPRRLVLKPAGTLGRGPPPPALPSLHRTVEKKHALSL

SEQ ID NO: 815916 - protein, 356 aa, Homo sapiens
LQPGPAPAQLHSRASFCTARSGSAAALRMRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCVILPHIGSATHRTRNTMSLLAANNLLAGLRGEPMPSELKL

SEQ ID NO: 815917 - protein, 347 aa, Homo sapiens
TPAWPRPGPATFPGQLLYCQVRVGGCTADETGATHEGVRHPQDTRRGCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCVILPHIGSATHRTRNTMSLLAANNLLAGLRGEPMPSELKL

SEQ ID NO: 815918 - protein, 356 aa, Homo sapiens; identical to SEQ ID NO: 815916

SEQ ID NO: 815919 - protein, 356 aa, Homo sapiens; identical to SEQ ID NO: 815916

SEQ ID NO: 815920 - protein, 356 aa, Homo sapiens; identical to SEQ ID NO: 815916

SEQ ID NO: 815921 - protein, 303 aa, Homo sapiens
LQPGPAPAQLHSRASFCTARSGSAAALRMRPVRLMKVFVTRRIPAEGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCVILPHIGSATHRTRNTMSLLAANNLLAGLRGEPMPSELKL

SEQ ID NO: 815922 - protein, 260 aa, Homo sapiens
MQVWANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCVILPHIGSATHRTRNTMSLLAANNLLAGLRGEPMPSELKL

SEQ ID NO: 815923 - protein, 356 aa, Homo sapiens; identical to SEQ ID NO: 815916

SEQ ID NO: 815924 - protein, 242 aa, Homo sapiens
MLPPRCLIRSGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCVILPHIGSATHRTRNTMSLLAANNLLAGLRGEPMPSELKL

SEQ ID NO: 815925 - protein, 356 aa, Homo sapiens; identical to SEQ ID NO: 815916

SEQ ID NO: 815926 - protein, 250 aa, Homo sapiens
LQPGPAPAQLHSRASFCTARSGSAAALRMRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGEAPTGPLARPGSHSVVCIPGTTCLKAEKTHMLSGHFACSRDISNEGYSFVKHRQIHK

SEQ ID NO: 815927 - protein, 241 aa, Homo sapiens
TPAWPRPGPATFPGQLLYCQVRVGGCTADETGATHEGVRHPQDTRRGCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGEAPTGPLARPGSHSVVCIPGTTCLKAEKTHMLSGHFACSRDISNEGYSFVKHRQIHK

SEQ ID NO: 815928 - protein, 249 aa, Homo sapiens
LQPGPAPAQLHSRASFCTARSGSAAALRMRPVRLMKVFVTRRIPAEGRVALARAADGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCVILPHIGSATHRTRNTMSLLAANNLLAGLRGEPMPSELKL

SEQ ID NO: 815929 - protein, 260 aa, Homo sapiens
MSLVALKVESFLLLICSAEWQCLIPLSVRDLEGGFIPWTTVRGAGFSAAPILVQGWASHLPLSLLLSGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCVILPHIGSATHRTRNTMSLLAANNLLAGLRGEPMPSELKL

SEQ ID NO: 815930 - protein, 185 aa, Homo sapiens [sequence omitted]

SEQ ID NO: 815931 - protein, 229 aa, Homo sapiens
LQPGPAPAQLHSRASFCTARSGSAAALRMRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFGK

SEQ ID NO: 815932 - protein, 185 aa, Homo sapiens [sequence omitted]

SEQ ID NO: 815933 - protein, 423 aa, Homo sapiens
LQPGPAPAQLHSRASFCTARSGSAAALRMRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRYPRATLPSKPGEEPSPLLPSGDFLPRGLLVRPQAELAGFHKPNNQLRNSWEYTRPPYREEEPSEWAWPVCFSAVAPTRRGLAHSSVASGSVPREPLQAHYPPPQRAGLEDLKGPLEAASHTAEPGFVWLWFSDTLNLMLLGGQTLKLTWS

SEQ ID NO: 815934 - protein, 322 aa, Homo sapiens
LQPGPAPAQLHSRASFCTARSGSAAALRMRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCGKNCTF

SEQ ID NO: 815935 - protein, 228 aa, Homo sapiens
LQPGPAPAQLHSRASFCTARSGSAAALRMRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAATRTSSRR

SEQ ID NO: 815936 - protein, 311 aa, Homo sapiens
LQPGPAPAQLHSRASFCTARSGSAAALRMRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEGRCDSLRKE

SEQ ID NO: 815937 - protein, 315 aa, Homo sapiens
LQPGPAPAQLHSRASFCTARSGSAAALRMRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPDSWVQAILLPQLPE

SEQ ID NO: 815938 - protein, 423 aa, Homo sapiens; identical to SEQ ID NO: 815933

SEQ ID NO: 815939 - protein, 293 aa, Homo sapiens
LQPGPAPAQLHSRASFCTARSGSAAALRMRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLRGEPMPSELKL

SEQ ID NO: 815940 - protein, 423 aa, Homo sapiens; identical to SEQ ID NO: 815933

SEQ ID NO: 815941 - protein, 316 aa, Homo sapiens
LQPGPAPAQLHSRASFCTARSGSAAALRMRPVRLMKVFVTRRIPAEGRVALARAADGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRYPRATLPSKPGEEPSPLLPSGDFLPRGLLVRPQAELAGFHKPNNQLRNSWEYTRPPYREEEPSEWAWPVCFSAVAPTRRGLAHSSVASGSVPREPLQAHYPPPQRAGLEDLKGPLEAASHTAEPGFVWLWFSDTLNLMLLGGQTLKLTWS

SEQ ID NO: 815942 - protein, 262 aa, Homo sapiens
LQPGPAPAQLHSRASFCTARSGSAAALRMRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKM

SEQ ID NO: 815943 - protein, 287 aa, Homo sapiens
LQPGPAPAQLHSRASFCTARSGSAAALRMRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTLILPHIGSATHRTRNTMSLLAANNLLAGLRGEPMPSELKL

SEQ ID NO: 815944 - protein, 250 aa, Homo sapiens; identical to SEQ ID NO: 815926

SEQ ID NO: 815945 - protein, 163 aa, Homo sapiens
LQPGPAPAQLHSRASFCTARSGSAAALRMRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKK

SEQ ID NO: 815946 - protein, 115 aa, Homo sapiens
TPAWPRPGPATFPGQLLYCQVRVGGCTADETGATHEGVRHPQDTRRGCEVEQWDSDEPIPAKELERGVAGAHGLLCLLSDHVDKRILDAAGANLKVISTMSVGIDHLALDEIKKR

SEQ ID NO: 815947 - protein, 264 aa, Homo sapiens
ILHRTRSSQLHPRGRLPGQWLGSARRHSNPSRPRLLDLLTGHRGRGLGPATSPRSPPPPPPPGFSLTHGSRPLPLFSLTARAPGGECVSRPGRGAVCISYAGSLAPGSRAASPAVAGAAKSAISGPLRPQASRRAVRSPSSSAQPAACGGVRRRQASASSSVSRCGRRSSLHLLLGPPSLPSSHFPSSGVSRPRSTLLQEQRKTPRRRRRHLRLLLRPAPGPRRRHQGARLSLPGGLGPASSCRLRARTRLSHLGPCRALKRSL

SEQ ID NO: 815948 - protein, 213 aa, Homo sapiens
MAQETNQTPGPMLCSTGCGFYGNPRTNGMCSVCYKEHLQRQQNSGRMSPMGTASGSNSPTSDSASVQRADTSLNNCEGAAGSTSEKSRNVPVAALPVTQQMTEMSISREDKITTPKTEVSEPVVTQPSPSVSQPSTSQSEEKAPELPKPKKNRCFMCRKKVGLTGFDCRCGNLFCGLHRYSDKHNCPYDYKAEAAAKIRKENPVVVAEKIQRI

SEQ ID NO: 815949 - protein, 474 aa, Homo sapiens
ILHRTRSSQLHPRGRLPGQWLGSARRHSNPSRPRLLDLLTGHRGRGLGPATSPRSPPPPPPPGFSLTHGSRPLPLFSLTARAPGGECVSRPGRGAVCISYAGSLAPGSRAASPAVAGAAKSAISGPLRPQASRRAVRSPSSSAQPAACGGVRRRQASASSSVSRCGRRSSLHLLLGPPSLPSSHFPSSGVSRPRSTLLQEQRKTPRRRRRHLRLLLRPAPGPRRRHQGARLSLPGGLGPASSCRLRARTRLSHLGPCRQKNMAQETNQTPGPMLCSTGCGFYGNPRTNGMCSVCYKEHLQRQQNSGRMSPMGTASGSNSPTSDSASVQRADTSLNNCEGAAGSTSEKSRNVPVAALPVTQQMTEMSISREDKITTPKTEVSEPVVTQPSPSVSQPSTSQSEEKAPELPKPKKNRCFMCRKKVGLTGFDCRCGNLFCGLHRYSDKHNCPYDYKAEAAAKIRKENPVVVAEKIQRI

SEQ ID NO: 815950 - protein, 392 aa, Homo sapiens
ILHRTRSSQLHPRGRLPGQWLGSARRHSNPSRPRLLDLLTGHRGRGLGPATSPRSPPPPPPPGFSLTHGSRPLPLFSLTARAPGGECVSRPGRGAVCISYAGSLAPGSRAASPAVAGAAKSAISGPLRPQASRRAVRSPSSSAQPAACGGVRRRQASASSSVSRCGRRSSLHLLLGPPSLPSSHFPSSGVSRPRSTLLQEQRKTPRRRRRHLRLLLRPAPGPRRRHQGARLSLPGGLGPASSCRLRARTRLSHLGPCRVSDTGLRVGAGLLVAGPGAGGSPPASPGSTKTEASSCRRGPRPGSRRPWLAPQHGRETMHGVPPLRGRPLGRSPPRRRPAWAPRPRETKRPRRRPRPLPVAAPPSSPLRGAVRGRGSGVGDPRGACRRRAGRAC

SEQ ID NO: 815951 - protein, 385 aa, Homo sapiens
ILHRTRSSQLHPRGRLPGQWLGSARRHSNPSRPRLLDLLTGHRGRGLGPATSPRSPPPPPPPGFSLTHGSRPLPLFSLTARAPGGECVSRPGRGAVCISYAGSLAPGSRAASPAVAGAAKSAISGPLRPQASRRAVRSPSSSAQPAACGGVRRRQASASSSVSRCGRRSSLHLLLGPPSLPSSHFPSSGVSRPRSTLLQEQRKTPRRRRRHLRLLLRPAPGPRRRHQGARLSLPGGLGPASSCRLRARTRLSHLGPCRVSDTGLRVGAGLLVAGPGAGVKGPGRRGPMAKPEQAGMAASGGGEPARQPRKHKDGGVILSSWPETWLPASLARSTARSGNNARRAASAGPASRPLASAAAPGVGTTTQRNKEAEAAAAPPARCSPP

SEQ ID NO: 815952 - protein, 342 aa, Homo sapiens
ILHRTRSSQLHPRGRLPGQWLGSARRHSNPSRPRLLDLLTGHRGRGLGPATSPRSPPPPPPPGFSLTHGSRPLPLFSLTARAPGGECVSRPGRGAVCISYAGSLAPGSRAASPAVAGAAKSAISGPLRPQASRRAVRSPSSSAQPAACGGVRRRQASASSSVSRCGRRSSLHLLLGPPSLPSSHFPSSGVSRPRSTLLQEQRKTPRRRRRHLRLLLRPAPGPRRRHQGARLSLPGGLGPASSCRLRARTRLSHLGPCRVSDTGLRVGAGLLVAGPGAGVKGPGRRGPMAKPEQAADGGVRGRGARPPAQEAQRRRRHPVVVARDLAPGVPGSLHSTALKRSL

SEQ ID NO: 815953 - protein, 264 aa, Homo sapiens; identical to SEQ ID NO: 815947

SEQ ID NO: 815954 - protein, 264 aa, Homo sapiens; identical to SEQ ID NO: 815947

SEQ ID NO: 815955 - protein, 552 aa, Homo sapiens
ILHRTRSSQLHPRGRLPGQWLGSARRHSNPSRPRLLDLLTGHRGRGLGPATSPRSPPPPPPPGFSLTHGSRPLPLFSLTARAPGGECVSRPGRGAVCISYAGSLAPGSRAASPAVAGAAKSAISGPLRPQASRRAVRSPSSSAQPAACGGVRRRQASASSSVSRCGRRSSLHLLLGPPSLPSSHFPSSGVSRPRSTLLQEQRKTPRRRRRHLRLLLRPAPGPRRRHQGARLSLPGGLGPASSCRLRARTRLSHLGPCRVSDTGLRVGAGLLVAGPGAGVKGPGRRGPMAKPEQAADGGVRGRGARPPAQEAQRRRRHPVVVARDLAPGVPGSLHSTQKNMAQETNQTPGPMLCSTGCGFYGNPRTNGMCSVCYKEHLQRQQNSGRMSPMGTASGSNSPTSDSASVQRADTSLNNCEGAAGSTSEKSRNVPVAALPVTQQMTEMSISREDKITTPKTEVSEPVVTQPSPSVSQPSTSQSEEKAPELPKPKKNRCFMCRKKVGLTGFDCRCGNLFCGLHRYSDKHNCPYDYKAEAAAKIRKENPVVVAEKIQRI

SEQ ID NO: 815956 - protein, 264 aa, Homo sapiens; identical to SEQ ID NO: 815947

SEQ ID NO: 815957 - protein, 264 aa, Homo sapiens; identical to SEQ ID NO: 815947

SEQ ID NO: 815958 - protein, 264 aa, Homo sapiens; identical to SEQ ID NO: 815947

SEQ ID NO: 815959 - protein, 113 aa, Homo sapiens
MTEMSISREDKITTPKTEVSEPVVTQPSPSVSQPSTSQSEEKAPELPKPKKNRCFMCRKKVGLTGFDCRCGNLFCGLHRYSDKHNCPYDYKAEAAAKIRKENPVVVAEKIQRI

SEQ ID NO: 815960 - protein, 264 aa, Homo sapiens; identical to SEQ ID NO: 815947

SEQ ID NO: 815961 - protein, 264 aa, Homo sapiens; identical to SEQ ID NO: 815947

SEQ ID NO: 815962 - protein, 264 aa, Homo sapiens; identical to SEQ ID NO: 815947

SEQ ID NO: 815963 - protein, 264 aa, Homo sapiens; identical to SEQ ID NO: 815947

SEQ ID NO: 815964 - protein, 264 aa, Homo sapiens; identical to SEQ ID NO: 815947

SEQ ID NO: 815965 - protein, 474 aa, Homo sapiens; identical to SEQ ID NO: 815949

SEQ ID NO: 815966 - protein, 264 aa, Homo sapiens; identical to SEQ ID NO: 815947

SEQ ID NO: 815967 - protein, 264 aa, Homo sapiens; identical to SEQ ID NO: 815947

SEQ ID NO: 815968 - protein, 335 aa, Homo sapiens
ILHRTRSSQLHPRGRLPGQWLGSARRHSNPSRPRLLDLLTGHRGRGLGPATSPRSPPPPPPPGFSLTHGSRPLPLFSLTARAPGGECVSRPGRGAVCISYAGSLAPGSRAASPAVAGAAKSAISGPLRPQASRRAVRSPSSSAQPAACGGVRRRQASASSSVSRCGRRSSLHLLLGPPSLPSSHFPSSGVSRPRSTLLQEQRKTPRRRRRHLRLLLRPAPGPRRRHQGARLSLPGGLGPASSCRLRARTRLSHLGPCRQKNMAQETNQTPGPMLCSTGCGFYGNPRTNGMCSVCYKEHLQRQQNSGRMSPMGKLFPRKNTFERTGGQKYRTKNWG

SEQ ID NO: 815969 - protein, 83 aa, Homo sapiens
RANSQILTLVQVQAILESPGGLVVRFGRFSPPRAGFVSRSGNPSFLGSDLGRGDMAKRTKKVGIVGKYGTRYGAIPPENGEEN

SEQ ID NO: 815970 - protein, 116 aa, Homo sapiens
LRAAMAVEKAASASRVLSRAWGGRRQREIFVFQVAATWPNVPRKSGSSVNTGPAMGPSLRKMVKKIEISQHAKYTCSFCGKTKMKRRAVGIWHCGSCMKTVAGGAWGRTIPLPLSR

SEQ ID NO: 815971 - protein, 98 aa, Homo sapiens
RERERERERERERERVAATWPNVPRKSGSSVNTGPAMGPSLRKMVKKIEISQHAKYTCSFCGKTKMKRRAVGIWHCGSCMKTVAGGAWGRTIPLPLSR

SEQ ID NO: 815972 - protein, 97 aa, Homo sapiens
LDIEFAPRYGCEETTKGDWPNVPRKSGSSVNTGPAMGPSLRKMVKKIEISQHAKYTCSFCGKTKMKRRAVGIWHCGSCMKTVAGGAWGRTIPLPLSR

SEQ ID NO: 815973 - protein, 94 aa, Homo sapiens
KKLGYYGLVLNQAEAWPNVPRKSGSSVNTGPAMGPSLRKMVKKIEISQHAKYTCSFCGKTKMKRRAVGIWHCGSCMKTVAGGAWGRTIPLPLSR

SEQ ID NO: 815974 - protein, 49 aa, Homo sapiens
MARGRGEKEGEERKGHRGGHKRVAPGHPEFPGATKGDKRGGPPKGGGNK

SEQ ID NO: 815975 - protein, 83 aa, Homo sapiens; identical to SEQ ID NO: 815969

SEQ ID NO: 815976 - protein, 99 aa, Homo sapiens
MVRDMGNKRASWENLGHLQASGEEGHAVEDSGDHGGTNKARRGSLHGRELDFRTLAKPKIASWAELWDQAAGHVKMNFRGALVDNTLATEDTGHVMMPH

SEQ ID NO: 815977 - protein, 69 aa, Homo sapiens
RVDRREAPERVPYLPMKKIEISQHAKYTCSFCGKTKMKRRAVGIWHCGSCMKTVAGGAWGRTIPLPLSR

SEQ ID NO: 815978 - protein, 67 aa, Homo sapiens
PFEFPSEIRGRLLLLNSRPRRHQDEETSCGDLALWFLHEDSGWRCLGTYNTTSAVTVKSAIRRLEGV

SEQ ID NO: 815979 - protein, 93 aa, Homo sapiens
RIQRWIRIRHQPATWPNVPRKSGSSVNTGPAMGPSLRKMVKKIEISQHAKYTCSFCGKTKMKRRAVGIWHCGSCMKTVAGGAWGRTIPLPLSR

SEQ ID NO: 815980 - protein, 93 aa, Homo sapiens; identical to SEQ ID NO: 815979

SEQ ID NO: 815981 - protein, 102 aa, Homo sapiens
VCQIDGLTDEADSEVKKIEISQHAKYTCSFCGKTKMKRRAVGIWHCGSCMKTVAGGAWGRTIPLPLSTVKAASGPFNASGFNASGPFNASGPFNASGPFNAS

SEQ ID NO: 815982 - protein, 68 aa, Homo sapiens
SEVVAPLYPAGASILAPGAYETAKSPCSRDKPADLGRGDMAKRTKKVGIVGKYGTRYGAIPPENGEEN

SEQ ID NO: 815983 - protein, 98 aa, Homo sapiens
ATTAGTYGLGTRPGWCAATWPNVPRKSGSSVNTGPAMGPSLRKMVKKIEISQHAKYTCSFCGKTKMKRRAVGIWHCGSCMKTVAGGAWGRTIPLPLSR

SEQ ID NO: 815984 - protein, 98 aa, Homo sapiens; identical to SEQ ID NO: 815983

SEQ ID NO: 815985 - protein, 101 aa, Homo sapiens
MFGKAGRSTRRRKKAERRHHGGTPPTASHASSRMLCSRGETAAEPAKQQNTAAGKTAEKSQKADRQHAHNPHTGNGHTEANTTGDKHRQGANSGQPEPQTA

SEQ ID NO: 815986 - protein, 170 aa, Homo sapiens
MCVTQGSTHSSVNVPPLATLLKVGKISGVPQRRLTVGAQRPSQGHQGDSQYSEAMPDISKDTSEVTRSIRWPPSDDLNVSPLSLLRVFLATWPNVPRKSGSSVNTGPAMGPSLRKMVKKIEISQHAKYTCSFCGKTKMKRRAVGIWHCGSCMKTVAGGAWGRTIPLPLSR

SEQ ID NO: 815987 - protein, 99 aa, Homo sapiens
MVGIWEIKEPAGRTWDTSRPPEKKGTLLEDSGDHGGTNKARRGSLHGRELDFRTLAKPKIASWAELWDQAAGHVKMNFRGALVDNTLATEDTGHVMMPH

SEQ ID NO: 815988 - protein, 135 aa, Homo sapiens
MRQKTHDDNSQNQKQATGHTTTQIWKNNTTIERDKKNTAAKNKSEKKTKKRWKEDNNKKKHTRKISKATYRNKKKKKESKTRQEKTREKATRKLAKQDERETDKEKRREERKEKRRKKAKRRRTKQEKQEDQEER

SEQ ID NO: 815989 - protein, 97 aa, Homo sapiens
VLRLTKLVVDSHVQYRLGNVDAFQLADGLQYIFAHVGQLTGMYRYKYKLMRQIRMCKDLKHLIYYRFNTAKRTKKVGIVGKYGTRYGAIPPENGEEN

SEQ ID NO: 815990 - protein, 92 aa, Homo sapiens
GRRGSTHASVAATWPNVPRKSGSSVNTGPAMGPSLRKMVKKIEISQHAKYTCSFCGKTKMKRRAVGIWHCGSCMKTVAGGAWGRTIPLPLSR

SEQ ID NO: 815991 - protein, 105 aa, Homo sapiens
RPPTTTKFAAASTREDDRRGFLGAATWPNVPRKSGSSVNTGPAMGPSLRKMVKKIEISQHAKYTCSFCGKTKMKRRAVGIWHCGSCMKTVAGGAWGRTIPLPLSR

SEQ ID NO: 815992 - protein, 49 aa, Homo sapiens
MARGRGEKEGEERKGHRGGHKRVAPEHPEFPGATKGDKRGGPPKGGGNK

SEQ ID NO: 815993 - protein, 83 aa, Homo sapiens; identical to SEQ ID NO: 815969

SEQ ID NO: 815994 - protein, 99 aa, Homo sapiens
MVRDMGNKRASWENLGHLQASGEEGHAVEDSGDHGGTNKARRGSLHGRELDFRTLAKPKIASWAELWESGGGPCEDEPPGSPVDNTLATEDTGHVMMPH

SEQ ID NO: 815995 - protein, 75 aa, Homo sapiens
MPPAWAKSILDSGRFMHAAEFRVNLPISPIAGRFTIHWSPFYNGVTVKPLALPNFAFEDNPLSPAWRSATGPPRP

SEQ ID NO: 815996 - protein, 110 aa, Homo sapiens
MGGKPLAQDTLAETNCFDAVRWSSSDKRVPWLKMSSWAILVDTTLLLQIMGRFQQRFALTEVGRNTTEEWASNTKLTGQPAFEKGTGSGLLNVPRWGNSGGRHMRNGYRS

SEQ ID NO: 815997 - protein, 62 aa, Homo sapiens
MNPFDRGSGFGNGVQRVFGGPKQRSKGNGHGVVELLTGLLDRGNPTMKVSLSMTKGYAGTGW

SEQ ID NO: 815998 - protein, 116 aa, Homo sapiens; identical to SEQ ID NO: 815970

SEQ ID NO: 815999 - protein, 105 aa, Homo sapiens; identical to SEQ ID NO: 815991

SEQ ID NO: 816000 - protein, 98 aa, Homo sapiens; identical to SEQ ID NO: 815971

SEQ ID NO: 816001 - protein, 110 aa, Homo sapiens; identical to SEQ ID NO: 815996

SEQ ID NO: 816002 - protein, 92 aa, Homo sapiens
RERERERERERERERVAATWPNVPRKSGSSVNTGPAMGPSLRKMVKKIEISQHAKYTCSFCGKTKMKRRAVGIWHCGSCMKTVAGGAWGRTK

SEQ ID NO: 816003 - protein, 105 aa, Homo sapiens
MESKCSDQGTGTEITVDTTWHDPIRLSPGKIIPWQDPVRLHFLASPHCKIQDHASLPSACKTCPSPQLQETDLSQAPVFLCSCGDLALWFLHERQWLAGLDVQVT

SEQ ID NO: 816004 - protein, 66 aa, Homo sapiens
MVKKIEISQHAKYTCSFCGKTKMKRRAVGIWHCGSCMKTVAGGAWGRTIPFPFLTLSAPIRELKEF

SEQ ID NO: 816005 - protein, 263 aa, Homo sapiens
GPDVRGRGGTAQAQKRGRRTRLVVLLPECRRRSCCCRSPASCPTMSSHLVEPPPPLHNNNNNCEENEQSLPPPAGLNSSWVELPMNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMRKSGAMKKGGIFSAEFLKVFIPSLFLSHVLALGLGIYIGKRLSTPSASTY

SEQ ID NO: 816006 - protein, 263 aa, Homo sapiens; identical to SEQ ID NO: 816005

SEQ ID NO: 816007 - protein, 263 aa, Homo sapiens; identical to SEQ ID NO: 816005

SEQ ID NO: 816008 - protein, 263 aa, Homo sapiens; identical to SEQ ID NO: 816005

SEQ ID NO: 816009 - protein, 263 aa, Homo sapiens; identical to SEQ ID NO: 816005

SEQ ID NO: 816010 - protein, 256 aa, Homo sapiens
GPDVRGRGGTAQAQKRGRRTRLVVLLPECRRRSCCCRSPASCPTMSSHLVEPPPPLHNNNNNCEENEQSLPPPAGLNSSWVELPMNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMSVHSISLPFSCFGFGARHLYWKATEHTLCQHLLRERKSPWKCV

SEQ ID NO: 816011 - protein, 208 aa, Homo sapiens
GSWARGRLGSRSGSGAGSADPPGSWVELPMNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMRKSGAMKKGGIFSAEFLKVFIPSLFLSHVLALGLGIYIGKRLSTPSASTY

SEQ ID NO: 816012 - protein, 115 aa, Homo sapiens
MSDAEDVVISAFPSESEEEVVEGEKEVEALKKSADWVSDWSSRPENIPPKEFHFRHPKRSVSLSMRKSGAMKKGGIFSAEFLKVFIPSLFLSHVLALGLGIYIGKRLSTPSASTY

SEQ ID NO: 816013 - protein, 263 aa, Homo sapiens; identical to SEQ ID NO: 816005

SEQ ID NO: 816014 - protein, 101 aa, Homo sapiens
AAIYTVRHPEWHLNSDYSYGFAYILAWVAFPLALLSGVIYVILLETRMRRPDGLSEALSVHREEEEGKTENKTKKKGKAQQKNILGNKKNILNQLWSHFFV

SEQ ID NO: 816015 - protein, 263 aa, Homo sapiens; identical to SEQ ID NO: 816005

SEQ ID NO: 816016 - protein, 263 aa, Homo sapiens; identical to SEQ ID NO: 816005

SEQ ID NO: 816017 - protein, 179 aa, Homo sapiens
MNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMRKSGAMKKGGIFSAEFLKVFIPSLFLSHVLALGLGIYIGKRLSTPSASTY

SEQ ID NO: 816018 - protein, 179 aa, Homo sapiens; identical to SEQ ID NO: 816017

SEQ ID NO: 816019 - protein, 83 aa, Homo sapiens
KVGVKRGPTSGKLTQTSGKTTQTHRETAGDGKSIKAFKICKADAGTPANSWELGLERWPRTPKEEAQSLEDLAGFKELFQTPD

SEQ ID NO: 816020 - protein, 148 aa, Homo sapiens
GPDVRGRGGTAQAQKRGRRTRLVVLLPECRRRSCCCRSPASCPTMSSHLVEPPPPLHNNNNNCEENEQSLPPPAGLNSSWVELPMNSSNGNDNGNGKNGGLEHVPSSSSIHKNNEKGKDLYNALTKELGAEYKPNNIALLISPWAIYV

SEQ ID NO: 816021 - protein, 252 aa, Homo sapiens
RSGAPANQRQSPNVGPAQPRPALLFVVSAGPRESNHNIRRAGGGGAGGGAAAAAVSASPGAPGGRPPAPAQPRVCVRPETPGPAPRRAMSVNMDELRHQVMINQFVLAAGCAADQAKQLLQAAHWQFETALSTFFQETNIPNSHHHHQMMCTPSNTPATPPNFPDALAMFSKLRASEGLQSSNSPMTAAACSPPANFSPFWASSPPSHQAPWIPPSSPTTFHHLHRPQPTWPPGAQQGGAQQKAMAAMDGQR

SEQ ID NO: 816022 - protein, 252 aa, Homo sapiens; identical to SEQ ID NO: 816021

SEQ ID NO: 816023 - protein, 178 aa, Homo sapiens
RSGAPANQRQSPNVGPAQPRPALLFVVSAGPRESNHNIRRAGGGGAGGGAAAAATALSTFFQETNIPNSHHHHQMMCTPSNTPATPPNFPDALAMFSKLRASEGLQSSNSPMTAAACSPPANFSPFWASSPPSHQAPWIPPSSPTTFHHLHRPQPTWPPGAQQGGAQQKAMAAMDGQR

SEQ ID NO: 816024 - protein, 223 aa, Homo sapiens
RSGAPANQRQSPNVGPAQPRPALLFVVSAGPRESNHNIRRAGGGGAGGGAAAAAVSASPGAPGGRPPAPAQPRVCVRPETPGPAPRRAMSVNMDELRHQVMINQFVLAAGCAADQAKQLLQAAHWQFETALSTFFQETNIPNSHHHHQMMCTPSNTPATPPNFPDALAMFSKLRASEGLQSSNSPMTAAACSPPANFSPFWASSPPSHQAPQQKAMAAMDGQR

SEQ ID NO: 816025 - protein, 170 aa, Homo sapiens
RSGAPANQRQSPNVGPAQPRPALLFVVSAGPRESNHNIRRAGGGGAGGGAAAAAVSASPGAPGGRPPAPAQPRVCVRPETPGPAPRRAMSVNMDELRHQVMINQFVLAAGCAADQAKQLLQAAHWQFETALSTFFQETNIPNSHHHHQMMCTPSNTPATPPNFPDAWKIL

SEQ ID NO: 816026 - protein, 252 aa, Homo sapiens; identical to SEQ ID NO: 816021

SEQ ID NO: 816027 - protein, 252 aa, Homo sapiens; identical to SEQ ID NO: 816021

SEQ ID NO: 816028 - protein, 252 aa, Homo sapiens; identical to SEQ ID NO: 816021

SEQ ID NO: 816029 - protein, 252 aa, Homo sapiens; identical to SEQ ID NO: 816021

SEQ ID NO: 816030 - protein, 252 aa, Homo sapiens; identical to SEQ ID NO: 816021

SEQ ID NO: 816031 - protein, 76 aa, Homo sapiens
MIAGEHRLDPATISLGVDQTDDHQQPTHSRIRKKRVSPTSVWFQPYFCILKTLCTTLDTVQDDATSSWMLICHVDF

SEQ ID NO: 816032 - protein, 517 aa, Homo sapiens
AACGGEGGFSGSMKRTPTAEEREREAKKLRLLEELEDTWLPYLTPKDDEFYQQWQLKYPKLILREASSVSEELHKEVQEAFLTLHKHGCLFRDLVRIQGKDLLTPVSRILIGNPGCTYKYLNTRLFTVPWPVKGSNIKHTEAEIAAACETFLKLNDYLQIETIQALEELAAKEKANEDAVPLCMSADFPRVGMGSSYNGQDEVDIKSRAAYNVTLLNFMDPQKMPYLKEEPYFGMGKMAVSWHHDENLVDRSAVAVYSYSCEGPEEESEDDSHLEGRDPDIWHVGFKISWDIETPGLAIPLHQGDCYFMLDDLNATHQHCVLAGSQPRFSSTHRVAECSTGTLDYILQRCQLALQNVCDDVDNDDVSLKSFEPAVLKQGEEIHNEVEFEWLRQFWFQGNRYRKCTDWWCQPMAQLEALWKKMEGVTNAVLHEVKREGLPVEQRNEILTAILASLTARQNLRREWHARCQSRIARTLPADQKPECRPYWEKDDASMPLPFDLTDIVSELRGQLLEAKP

SEQ ID NO: 816033 - protein, 569 aa, Homo sapiens
AACGGEGGFSGSMKRTPTAEEREREAKKLRLLEELEDTWLPYLTPKDDEFYQQWQLKYPKLILREASSVSEELHKEVQEAFLTLHKHGCLFRDLVRIQGKDLLTPVSRILIGNPGCTYKYLNTRLFTVPWPVKGSNIKHTEAEIAAACETFLKLNDYLQIETIQALEELAAKEKANEDAVPLCMSADFPRVGMGSSYNGQDEVDIKSRAAYNVTLLNFMDPQKMPYLKEEPYFGMGKMAVSWHHDENLVDRSAVAVYSYSCEGPEEESEDDSHLEGRDPDIWHVGFKISWDIETPGLAIPLHQGDCYFMLDDLNATHQHCVLAGSQPRFSSTHRVAECSTGTLDYILQRCQLALQNVCDDVDNDDVSLKSFEPAVLKQGEEIHNEVEFEWLRQFWFQGNRYRKCTDWWCQPMAQLEALWKKMEGVTNAVLHEVKREGLPVEQRNEILTAILASLTARQNLRREWHARAERSVGASHELPEHYLLIRSQNVGHTGKRMMLRCLCRLTSQTSFQNSEVSFWKQNPRRSTSLRRRRKRDRLFSSNVVMGLSKSSGDFSWPLDCSTRVPIQNS

SEQ ID NO: 816034 - protein, 170 aa, Homo sapiens
AGPVRNLSGEAVVAPRFFSWAVFYIYRLRLSPAPPGPWVEFEWLRQFWFQGNRYRKCTDWWCQPMAQLEALWKKMEGVTNAVLHEVKREGLPVEQRNEILTAILASLTARQNLRREWHARCQSRIARTLPADQKPECRPYWEKDDASMPLPFDLTDIVSELRGQLLEAKP

SEQ ID NO: 816035 - protein, 127 aa, Homo sapiens
MEWRKVSECNSVEPCREVKKWPYRCIHHGKNFSRMTNAVLHEVKREGLPVEQRNEILTAILASLTARQNLRREWHARCQSRIARTLPADQKPECRPYWEKDDASMPLPFDLTDIVSELRGQLLEAKP

SEQ ID NO: 816036 - protein, 139 aa, Homo sapiens
MGHPRAIQPSVFFSPYDVHFLLYPIRCPYLKIGRFHIKLKGLHFLFSFLFFFFETQSHSVTRLECSGTISAHCNLCLPGSSNSPASASQVAGTTGTCHHAQLIFVFLAEMGFHHIGQDGLDLNLVIHPPRSPKALGLQA

SEQ ID NO: 816037 - protein, 322 aa, Homo sapiens
AACGGEGGFSGSMKRTPTAEEREREAKKLRLLEELEDTWLPYLTPKDDEFYQQWQLKYPKLILREASSVSEELHKEVQEAFLTLHKHGCLFRDLVRIQGKDLLTPVSRILIGNPGCTYKYLNTRLFTVPWPVKGSNIKHTEAEIAAACETFLKLNDYLQIETIQALEELAAKEKANEDAVPLCMSADFPRVGMGSSYNGQDEVDIKSRAAYNVTLLNFMDPQKMPYLKEEPYFGMGKMAVSWHHDENLVDRSAVAVYSYSCEGPEEESEDDSHLEGRDPDIWHVGFKISWDIETPGLAIPLHQGDCYFMLGNLWKIKIILKL

SEQ ID NO: 816038 - protein, 794 aa, Homo sapiens
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLGYRYWAGIGVLQSCESALTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGVQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDGDYNAAVIQYLLLAEQGYEVAQSNAAFILDQREASIVGENETYPRALLHWNRAASQGYTVARIKLGDYHFYGFGTDVDYETAFIHYRLASEQQHSAQAMFNLGYMHEKGLGIKQDIHLAKRFYDMAAEASPDAQVPVFLALCKLGVVYFLQYIRETNIRDMFTQLDMDQLLGPEWDLYLMTIIALLLGTVIAYRQRQHQDMPAPRPPGPRPAPPQQEGPPEQQPPQ

SEQ ID NO: 816039 - protein, 825 aa, Homo sapiens
KSSGEAAVVAESVVAEAKATALGVGTGPERRMRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLGYRYWAGIGVLQSCESALTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGVQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDGDYNAAVIQYLLLAEQGYEVAQSNAAFILDQREASIVGENETYPRALLHWNRAASQGYTVARIKLGDYHFYGFGTDVDYETAFIHYRLASEQQHSAQAMFNLGYMHEKGLGIKQDIHLAKRFYDMAAEASPDAQVPVFLALCKLGVVYFLQYIRETNIRDMFTQLDMDQLLGPEWDLYLMTIIALLLGTVIAYRQRQHQDMPAPRPPGPRPAPPQQEGPPEQQPPQ

SEQ ID NO: 816040 - protein, 663 aa, Homo sapiens
KSSGEAAVVAESVVAEAKATALGVGTGPERRMRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLGYRYWAGIGVLQSCESALTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGVQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDGDYNAAVIQYLLLAEQGYEVAQSNAAFILDQREASIVGENETYPRALLHWNRAASQATQCTSYV

SEQ ID NO: 816041 - protein, 768 aa, Homo sapiens
KSSGEAAVVAESVVAEAKATALGVGTGPERRMRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLGYRYWAGIGVLQSCESALTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGVQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDGDYNAAVIQYLLLAEQGYEVAQSNAAFILDQREASIVGENETYPRALLHWNRAASQGYTVARIKLGDYHFYGFGTDVDYETAFIHYRLASEQQHSAQAMFNLGYMHEKGLGIKQDIHLAKRFYDMAAEASPDAQVPVFLALCKLGVVYFLQYIRETNVSGPYLFSLKYK

SEQ ID NO: 816042 - protein, 107 aa, Homo sapiens
NAHTSKIKFMTSILIALGTILFISLLLAMAFLLKLLNPLPQNLTLSINKVLVYLDQMTAKFWVCLALFVPRRMTLKYMKLLPPHVKLFYRVTDTGLASASSRVVNLP

SEQ ID NO: 816043 - protein, 184 aa, Homo sapiens
MWVFGYGSLIWKVDFPYQDKLVGYITNYSRRFWQGSTDHRGVPGKPGRVVTLVEDPAGCVWGVAYRLPVGKEEEVKAYLDFREKGGYRTTTVIFYPKDPTTKPFSVLLYIGTCDNPDYLGPAPLEDIAEQIFNAAGPSGRNTEYLFELANSIRNLVPEEADEHLFALEKLVKERLEGKQNLNCI

SEQ ID NO: 816044 - protein, 184 aa, Homo sapiens; identical to SEQ ID NO: 816043

SEQ ID NO: 816045 - protein, 184 aa, Homo sapiens; identical to SEQ ID NO: 816043

SEQ ID NO: 816046 - protein, 280 aa, Homo sapiens
MAPSGSLAVPLAVLVLLLWGAPWTHGRRSNVRVITDENWRELLEGDWMIEFYAPWCPACQNLQPEWESFAEWGEDLEVNIAKVDVTEQPGLSGRFIITALPTIYHCKDGEFRRYQGPRTKKDFINFISDKEWKSIEPVSSWFGPGSVLMSSMSALFQLSMWIRTCHNYFIEDLGLPVWGSYTVFALATLFSGLLLGLCMIFVADCLCPSKRRRPQPYPYPSKKLLSESAQPLKKVEEEQEADEEDVSEEEAESKEGTNKDFPQNAIRQRSLGPSLATDKS

SEQ ID NO: 816047 - protein, 105 aa, Homo sapiens
MAPSGSLAVPLAVLVLLLWGAPWTHGRRSNVRVITDENWRELLEGDWMIEFYAPWCPACQNLQPEWESFAEWGEDLEVNIAKVDVTEQPGLSGRFIITALPTIYQ

SEQ ID NO: 816048 - protein, 280 aa, Homo sapiens; identical to SEQ ID NO: 816046

SEQ ID NO: 816049 - protein, 280 aa, Homo sapiens; identical to SEQ ID NO: 816046

SEQ ID NO: 816050 - protein, 280 aa, Homo sapiens; identical to SEQ ID NO: 816046

SEQ ID NO: 816051 - protein, 280 aa, Homo sapiens; identical to SEQ ID NO: 816046

SEQ ID NO: 816052 - protein, 185 aa, Homo sapiens
MAPSGSLAVPLAVLVLLLWGAPWTHGRRSNVRVITDENWRELLEGDWMIEFYAPWCPACQNLQPEWESFAEWGEDLEVNIAKVDVTEQPGLSGRFIITALPTIYHCKDGEFRRYQGPRTKKDFINFISDKEWKSIEPVSSWFGPGSVLMSSMSALFQLSMWIRTCHNYFIEDLGLPVWGSYTVFN

SEQ ID NO: 816053 - protein, 394 aa, Homo sapiens
MDSQGRKVVVCDNGTGFVKCGYAGSNFPEHIFPALVGRPIIRSTTKVGNIEIKDLMVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 816054 - protein, 124 aa, Homo sapiens
MVGSARTSRLAPRPTRQLLRHIPLPQQNRCPSPACVFCSSLSSALSSCDTLGRKPQHRRCWPPLTPGKAPGTRSSEEPGWAATVTAEPEAELREGPRRSSIFYWSSPLPVALPARPTLFVQAFS

SEQ ID NO: 816055 - protein, 44 aa, Homo sapiens
MDSQGRKVVVCDNGTGVRAARGGLGGHRRRRGRAAGARALGPQG

SEQ ID NO: 816056 - protein, 78 aa, Homo sapiens
MDSQGRKVVVCDNGTGFVKCGYAGSNFPEHIFPALVGRPIIRSTTKVGNIEIKETEVAVSRDRAIALQPGRQEKLCLN

SEQ ID NO: 816057 - protein, 394 aa, Homo sapiens; identical to SEQ ID NO: 816053

SEQ ID NO: 816058 - protein, 339 aa, Homo sapiens
MVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 816059 - protein, 339 aa, Homo sapiens; identical to SEQ ID NO: 816058

SEQ ID NO: 816060 - protein, 394 aa, Homo sapiens; identical to SEQ ID NO: 816053

SEQ ID NO: 816061 - protein, 394 aa, Homo sapiens; identical to SEQ ID NO: 816053

SEQ ID NO: 816062 - protein, 394 aa, Homo sapiens; identical to SEQ ID NO: 816053

SEQ ID NO: 816063 - protein, 394 aa, Homo sapiens; identical to SEQ ID NO: 816053

SEQ ID NO: 816064 - protein, 394 aa, Homo sapiens; identical to SEQ ID NO: 816053

SEQ ID NO: 816065 - protein, 394 aa, Homo sapiens; identical to SEQ ID NO: 816053

SEQ ID NO: 816066 - protein, 394 aa, Homo sapiens; identical to SEQ ID NO: 816053

SEQ ID NO: 816067 - protein, 394 aa, Homo sapiens; identical to SEQ ID NO: 816053

SEQ ID NO: 816068 - protein, 394 aa, Homo sapiens; identical to SEQ ID NO: 816053

SEQ ID NO: 816069 - protein, 394 aa, Homo sapiens; identical to SEQ ID NO: 816053

SEQ ID NO: 816070 - protein, 394 aa, Homo sapiens; identical to SEQ ID NO: 816053

SEQ ID NO: 816071 - protein, 394 aa, Homo sapiens; identical to SEQ ID NO: 816053

SEQ ID NO: 816072 - protein, 1319 aa, Homo sapiens
MFGLDQFEPQVNSRNAGQGERNFNETGLSMNTHFKAPAFHTGGPPGPVDPAMSALGQPPILGMNMEPYGFHARGHSELHAGGLQAQPVHGFFGGQQPHHGHPGSHHPHQHHPHFGGNFGGPDPGASCLHGGRLLGYGGAAGGLGSQPPFAEGYEHMAESQGPESFGPQRPGNLPDFHSSGASSHRVPAPCLPLDQSPNRAASFHGLPSSSGSDSHSLEPRRVTNQGAVDSLEYNYRARRPRDILTCFRPLTPKGSCLIMQRVARFLGGGFPGAPSAMPRAAGMVGLSKMHAQPPQQQPQQQQQPQQQQQHGVFFERFSGARKMPVGLEPSVGSRHPLMQPPQQAPPPPQQQPPQQPPQQQPPPPPGLLVRQNSLPACAPSAPAGRGGHAQRRPAGRRPHAAQPARAIRVSHPPAGEPEHAPLFRACFQHAASSSAAGAQPAAAAFRRAPLHERGQEARFDFPGSAGVDRCASWNGSMHNGALDNHLSPSAYPGLPGEFTPPVPDSFPSGPPLQHPAPDHQSLQQQQQQQQQQQQQQQQQQQQQQQQQQQQRQNAALMIKQMASRNQQQRLRQPNLAQLGHPGDVGQGGLVHGGPVGGLAQPNFEREGGSTGAGRLGTFEQQAPHLAQESAWFSGPHPPPGDLLPRRMGGSGLPADCGPHDPSLAPPPPPGGSGVLFRGPLQEPMRMPGEATCRAAFTGLQFGGSLGGLGQLQSPGAGVGLPSAASERRPPPPDFATSALGGQPGFPFGAAGRQSTPHSGPGVNSPPSAGGGGGSSGGGGGGGAYPPQPDFQPSQRTSASKLGALSLGSFNKPSSKDNLFGQSCLAALSTACQNMIASLGAPNLNVTFNKKNPPEGKRKLSQNETDGAAVAGNPGSDYFPGGTAPGGPRTRRPSGTSSSGSKASGPPNPPAQGDGTSLSPNYTLESTSGNDGKPVSGGGGRGRGRRKRDSGHVSPGTFFDKYSAAPDSGGAPGVSPGQQQASGAAVGGSSAGETRGAPTPHEKALTSPSWGKGAELLLGDQPDLIGSLDGGAKSDSSSPNVGEFASDEVSTSYANEDEVSSSSDNPQALVKASRSPLVTGSPKLPPRGVGAGEHGPKAPPPALGLGIMSNSTSTPDSYGGGGGPGHPGTPGLEQVRTPTSSSGAPPPDEIHPLEILQAQIQLQRQQFSISEDQPLGLKGGKKGECAVGASGAQNGDSELGSCCSEAVKSAMSTIDLDSLMAEHSAAWYMPADKALVDSADDDKTLAPWEKAKPQNPNSKEAHDLPANKASASQPGSHLQCLSVHCTDDVGDAKARASVPTWRSLHSDISNRFGTFVAALT

SEQ ID NO: 816073 - protein, 1319 aa, Homo sapiens; identical to SEQ ID NO: 816072

SEQ ID NO: 816074 - protein, 149 aa, Homo sapiens
MLALQNERTERIRSLLERQAREIEAFDSESMRLGFSNMVLSNLSPEAFSHSYPGASGWSHNPTGGPGPHWGHPMGGPPQAWGHPMQGGPQPWGHPSGPMQGVPRGSSMGVRNSPQALRRTASGGRTEQGMSRSTSVTSQISNGSHMSYT

SEQ ID NO: 816075 - protein, 149 aa, Homo sapiens; identical to SEQ ID NO: 816074

SEQ ID NO: 816076 - protein, 149 aa, Homo sapiens; identical to SEQ ID NO: 816074

SEQ ID NO: 816077 - protein, 3138 aa, Homo sapiens
SDSSGSREVDPVAATTMPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNKIIADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYVILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 816078 - protein, 3123 aa, Homo sapiens
MNPVPQMEKQKSPVFCVAHAGSCRPELFLFGHLGSSPKGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNKIIADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYVILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 816079 - protein, 666 aa, Homo sapiens
SSRSGVIDATKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYVILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 816080 - protein, 628 aa, Homo sapiens
MRFKDWNRTFRIFIVHSYRLQFGIGHETPTNVYTVSFPKPGFVELSPVPIDVGTEINLSFSTKNESGIILLGSGGTPAPPRRKRRQTGQAYYVILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 816081 - protein, 477 aa, Homo sapiens
MQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 816082 - protein, 3123 aa, Homo sapiens; identical to SEQ ID NO: 816078

SEQ ID NO: 816083 - protein, 3030 aa, Homo sapiens
MNPVPQMEKQKSPVFCVAHAGSCRPELFLFGHLGSSPKGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNKIIADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYVILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGLGFQGICVMDNGIKSLPTRSNTKGTGKPLEVNFAKALELRGVQPVSCPAN

SEQ ID NO: 816084 - protein, 3019 aa, Homo sapiens
MNPVPQMEKQKSPVFCVAHAGSCRPELFLFGHLGSSPKGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNKIIADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYVILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGPTNKNKCNPRKSLSKQVYQVKQTNIFYLYMLIKLICACT

SEQ ID NO: 816085 - protein, 2495 aa, Homo sapiens
MNPVPQMEKQKSPVFCVAHAGSCRPELFLFGHLGSSPKGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNKIIADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQATGMDLEVIILSDITQKQKIQYHMFSLTRREAKQWIHEDVKMETIDTGDSKRGEGGEGVKI

SEQ ID NO: 816086 - protein, 71 aa, Homo sapiens
LRSPQRLTDEISCLRCAEGYFGQPSVPGGSCQPCQCNDNLDFSIPGSCDSLSGSCLICKPGTTGRYCELCA

SEQ ID NO: 816087 - protein, 159 aa, Homo sapiens
MLQARKQHMSTELTIESEAPSDSSGINLSGFGSEQLDTNDESDVSSALSYILPYLSLRNLGAESILLPFTEQLFSNVQDGDRLLSILKNNRKSPSQSSLLGNKFKNKIFEKKIRNCATTGKPPGKDSKCRQKPAESEQSPHGPKEHPGKALQKGGKAQH

SEQ ID NO: 816088 - protein, 179 aa, Homo sapiens
MIYQTTEEASVGNPEGAFMKMLQARKQHMSTELTIESEAPSDSSGINLSGFGSEQLDTNDESDVSSALSYILPYLSLRNLGAESILLPFTEQLFSNVQDGDRLLSILKNNRKSPSQSSLLGNKFKNKIFEKKIRNCATTGKPPGKDSKCRQKPAESEQSPHGPKEHPGKALQKGGKAQH

SEQ ID NO: 816089 - protein, 309 aa, Homo sapiens
MIYQTTEEASVGNPEGAFMKMLQARKQHMSTELTIESEAPSDSSGINLSGFGSEQLDTNDESDVSSALSYILPYLSLRNLGAESILLPFTEQLFSNVQDGDRLLSILKNNRKSPSQSSLLGDQLEIQLTEQLRSLIPNEDVRKFMSHVIWTLKMECSETHVQGSCAKLMSRTGLLMKLLSEQQEAKALNVEWDTDQQKTNYINENMEQNEQKEQKSSELMKEVPGYDYKNKLIFAISVTVILIILIIIFCFIEVKTIINSGFQNTILCLCGFRIHKLKTNVTFPLDILLLSFKAEVCFVLLLQCIFQDC

SEQ ID NO: 816090 - protein, 221 aa, Homo sapiens
MLQARKQHMSTELTIESEAPSDSSGINLSGFGSDQLEIQLTEQLRSLIPNEDVRKFMSHVIWTLKMECSETHVQGSCAKLMSRTGLLMKLLSEQQEAKALNVEWDTDQQKTNYINENMEQNEQKEQKSSELMKEVPGYDYKNKLIFAISVTVILIILIIIFCFIEVKTIINSGFQNTILCLCGFRIHKLKTNVTFPLDILLLSFKAEVCFVLLLQCIFQDC

SEQ ID NO: 816091 - protein, 269 aa, Homo sapiens
MIYQTTEEASVGNPEGAFMKMLQARKQHMSTELTIESEAPSDSSGINLSGFGSEQLDTNDESDVSSALSYILPYLSLRNLGDQLEIQLTEQLRSLIPNEDVRKFMSHVIWTLKMECSETHVQGSCAKLMSRTGLLMKLLSEQQEAKALNVEWDTDQQKTNYINENMEQNEQKEQKSSELMKEVPGYDYKNKLIFAISVTVILIILIIIFCFIEVKTIINSGFQNTILCLCGFRIHKLKTNVTFPLDILLLSFKAEVCFVLLLQCIFQDC

SEQ ID NO: 816092 - protein, 269 aa, Homo sapiens
GYLEDPYQPLHATSYFLALLSTPSNSEMRDTSRWDESTRYVHVQGLHAMPNTPLPGPPGSLPQVLTWRTPHEHSPGFGRERRGMKALDMNSCRSLIPNEDVRKFMSHVIWTLKMECSETHVQGSCAKLMSRTGLLMKLLSEQQEAKALNVEWDTDQQKTNYINENMEQNEQKEQKSSELMKEVPGYDYKNKLIFAISVTVILIILIIIFCFIEVKTIINSGFQNTILCLCGFRIHKLKTNVTFPLDILLLSFKAEVCFVLLLQCIFQDC

SEQ ID NO: 816093 - protein, 111 aa, Homo sapiens
AVVVMDRKRVRRACLEASIREGCPRCRRSFLQVLLEDFWLASASPFSQRLGPDVIISLSLAAPEKSRSRQVTRSPPPGGEVKSARVLLVQGLHTGKKQGKSVRNSFCSTAF

SEQ ID NO: 816094 - protein, 159 aa, Homo sapiens; identical to SEQ ID NO: 816087

SEQ ID NO: 816095 - protein, 244 aa, Homo sapiens
MLAKRPLFSAAKSLIHSQGIFSSLGDLSPQENPLLEVVAPSERFTENTNVKDTTNVKDTKEMCSKTISENTNYNHPPEAVSAGTAFNLEPTVKQTETKWEYNNVGIDLSPEPKSFNYPLLSSPGDQLEIQLTEQLRSLIPNEDVRKFMSHVIWTLKMECSETHVQGSCAKLMSRTGLLMKLLSEQQEAKALNVEWDTDQQKTNYINENMEQNEQKEQKSSEVRSTQKHETQISHHLAYARKVPT

SEQ ID NO: 816096 - protein, 205 aa, Homo sapiens
LLCVTGAYSYGLSMKDDQRYFMIKAVSSFLTAEEASVGNPEGAFMKMLQARKQHMSTELTIESEAPSDSSGINLSGFGSEQLDTNDESDVSSALSYILPYLSLRNLGAESILLPFTEQLFSNVQDGDRLLSILKNNRKSPSQSSLLGNKFKNKIFEKKIRNCATTGKPPGKDSKCRQKPAESEQSPHGPKEHPGKALQKGGKAQH

SEQ ID NO: 816097 - protein, 113 aa, Homo sapiens
MHTVPWGVDFALIAMKNFISQWSSFFRSGMGKSQTGYLPRVPREQPFAAGLWGLAAALSHLAVNAFSLLCPPLPKTSCSLNPHGDVESRKVHATVENVYISALNLPWVRVKWC

SEQ ID NO: 816098 - protein, 74 aa, Homo sapiens
EEEQEAPYLNDLPEEAGPASSSAETGLHSMCSLLSSFFFLLKCSCLIPSTFLQSPHKAASPTHCYANKVLFNFI

SEQ ID NO: 816099 - protein, 131 aa, Homo sapiens
MGLIFSCLAFEEMVEFKLTGKPNQHPPLCSERLETSGPPHCPCPWQALKSGEVTTGLKISQCQHCLPCKVQLSPHSAFIVSLTTALGRRWKPEDVWVSQLTDKLPCHTQCPRMLTYIQQTTTLLPSSASKG

SEQ ID NO: 816100 - protein, 131 aa, Homo sapiens; identical to SEQ ID NO: 816099

SEQ ID NO: 816101 - protein, 522 aa, Homo sapiens
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVLRSFDSMISTNCTEELENAGVEVLKFSQVKEVKKTLSGLEVSMVTAVPGRLPVMTMIPDVDCLLWAIGRVPNTKDLSLNKLGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 816102 - protein, 522 aa, Homo sapiens; identical to SEQ ID NO: 816101

SEQ ID NO: 816103 - protein, 522 aa, Homo sapiens; identical to SEQ ID NO: 816101

SEQ ID NO: 816104 - protein, 449 aa, Homo sapiens
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVLRSFDSMISTNCTEELENAGVEVLKFSQVKEVKKTLSGLEVSMVTAVPGRLPVMTMIPDVDCLLWAIGRVPNTKDLSLNKLGIQTDDKGHIIVDEFQNTNVKGIYAVGDVCGKALLTPVAIAAGRKLAHRLFEYKEDSKLDYNNIPTVVFSHPPIGTVGLTEGRYLKTEGHLWFPSSFPCPQL

SEQ ID NO: 816105 - protein, 102 aa, Homo sapiens
KKTLSGLEVSMVTAVPGRLPVMTMIPDVDCLLWAIGRVPNTKDLSLNKLVSWLGLPETFVNLLGVLWFYFPPRHPKLGWIPLDSFLFFPCIQFVIKFHCFFL

SEQ ID NO: 816106 - protein, 464 aa, Homo sapiens
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 816107 - protein, 464 aa, Homo sapiens; identical to SEQ ID NO: 816106

SEQ ID NO: 816108 - protein, 419 aa, Homo sapiens
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLSFITLTKLEPWILVSE

SEQ ID NO: 816109 - protein, 145 aa, Homo sapiens [sequence omitted]

SEQ ID NO: 816110 - protein, 379 aa, Homo sapiens
MGSPAHRPALLLLLPPLLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQAVAANPTLLLQYGASG

SEQ ID NO: 816111 - protein, 138 aa, Homo sapiens
MATKRLFGATRTWAGWGAWELLNPATSGRLLARDYAKKPVMKGAKSGKGAVTSEALKDPDVCTDPVQLTTYAMGVNIYKEGQDVPLKPDAEYPEWLFEMNLGPPKTLEELDPESREYWRRLRKQNIWRHNRLSKNKRL

SEQ ID NO: 816112 - protein, 138 aa, Homo sapiens; identical to SEQ ID NO: 816111

SEQ ID NO: 816113 - protein, 138 aa, Homo sapiens; identical to SEQ ID NO: 816111

SEQ ID NO: 816114 - protein, 91 aa, Homo sapiens
MKEPGPNFVTVRKGLHSFKMAFVKHLLLECSGSITDHCSLHLPVQEILMSQPPEQLGLQTNLGNQESSGMMKLFMPRPKVLAQYESIQFMP

SEQ ID NO: 816115 - protein, 91 aa, Homo sapiens; identical to SEQ ID NO: 816114

SEQ ID NO: 816116 - protein, 91 aa, Homo sapiens; identical to SEQ ID NO: 816114

SEQ ID NO: 816117 - protein, 673 aa, Homo sapiens
MFDFEGSLSPVIAPKKARPSETGSDDDWEYLLNSDYHQSVESHLLNRSLCLSPSEASQMKDEDFSQNLSLDSSTLLFTHIPAIFFVLRLVYEELKLNTLMGEGICSLLNFSFSWQGQTGFMHHPSFFTSEPPSIYQWVSSCLKGEGMPPYPYLPGICERSRLVVLSIALYILGDESSVSDESSQYLTRITVAPQKLQAEQEENRFSFRHSTSVSSLAERLVGWMTNVGFTLRDLETLPFGIALPIRDAIYHCREQPASDWPEAVCLLTGRQDLSKQACEGNLPKGKSVLSSDVPSGTETEEEDDGMNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIRIPALLPPTSTELDVPHNVQVAAVVGIGLVYQGTAHRHTAEVLLAEIGRPPGPEMEYCTDRKSYSLAAGLALGMVCLGHGSNLIGMSDLNVPEQLYQYMVGGHRRFQTGMHREKHKSPSYQIKEGDTINVDVTCPGATLALAMIYLKTNNSVF

SEQ ID NO: 816118 - protein, 673 aa, Homo sapiens; identical to SEQ ID NO: 816117

SEQ ID NO: 816119 - protein, 673 aa, Homo sapiens; identical to SEQ ID NO: 816117

SEQ ID NO: 816120 - protein, 659 aa, Homo sapiens
MFDFEGSLSPVIAPKKARPSETGSDDDWEYLLNSDYHQSVESHLLNRSLCLSPSEASQMKDEDFSQNLSLDSSTLLFTHIPAIFFVLRLVYEELKLNTLMGEGICSLLNFSFSWQGQTGFMHHPSFFTSEPPSIYQWVSSCLKGEGMPPYPYLPGICERSRLVVLSIALYILGDESSVSDESSQYLTRITVAPQKLQAEQEENRFSFRHSTSVSSLAERLVGWMTNVGFTLRDLETLPFGIALPIRDAIYHCREQPASDWPEAVCLLTGRQDLSKQACEGNLPKGKSVLSSDVPSGTETEEEDDGMNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIRIPALLPPTSTELDVPHNVQVAAVVGIGLVYQGTAHRHTAEVLLAEIGRPPGPEMEYCTDRKSYSLAAGLALGMVCLGHGSNLIGMSDLNVPEQLYQYMVGGHRRFQTGMHREKHKSPSYQIKVSTQQSNRSKVWKLGS

SEQ ID NO: 816121 - protein, 628 aa, Homo sapiens
MFDFEGSLSPVIAPKKARPSETGSDDDWEYLLNSDYHQSVESHLLNRSLCLSPSEASQMKDEDFSQNLSLDSSTLLFTHIPAIFFVLRLVYEELKLNTLMGEGICSLLNFSFSWQGQTGFMHHPSFFTSEPPSIYQWVSSCLKGEGMPPYPYLPGICERSRLVVLSIALYILGDESSVSDESSQYLTRITVAPQKLQAEQEENRFSFRHSTSVSSLAERLVGWMTNVGFTLRDLETLPFGIALPIRDAIYHCREQPASDWPEAVCLLTGRQDLSKQACEGNLPKGKSVLSSDVPSGTETEEEDDGMNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIRIPALLPPTSTELDVPHNVQVAAVVGIGLVYQGTAHRHTAEVLLAEIGRPPGPEMEYCTDRKSYSLAAGLALGMVCLGEGDTINVDVTCPGATLALAMIYLKTNNSVF

SEQ ID NO: 816122 - protein, 692 aa, Homo sapiens
MFDFEGSLSPVIAPKKARPSETGSDDDWEYLLNSDYHQSVESHLLNRSLCLSPSEASQMKDEDFSQNLSLDSSTLLFTHIPAIFFVLRLVYEELKLNTLMGEGICSLLNFSFSWQGQTGFMHHPSFFTSEPPSIYQWVSSCLKGEGMPPYPYLPGICERSRLVVLSIALYILGDESSVSDESSQYLTRITVAPQKLQAEQEENRFSFRHSTSVSSLAERLVGWMTNVGFTLRDLETLPFGIALPIRDAIYHCREQPASDWPEAVCLLTGRQDLSKQACEGNLPKGKSVLSSDVPSGTETEEEDDGMNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIRIPALLPPTSTELDVPHNVQVAAVVGIGLVYQGTAHRHTAEVLLAEIGRPPGPEMEYCTDRKSYSLAAGLALGMVCLGHGSNLIGMSDLNVPEQLYQYMVGGHRRFQTGMHREKHKSPSYQIKEGDTINVDVTCPGATLALAMIYLKTNNRLQSAVAPAQNSAQCPSVLSRC

SEQ ID NO: 816123 - protein, 659 aa, Homo sapiens; identical to SEQ ID NO: 816120

SEQ ID NO: 816124 - protein, 46 aa, Homo sapiens
MVSFLSFLFVSHIRWAVLESPTGTEKMTTKQQQNPQEYPVVFGQSS

SEQ ID NO: 816125 - protein, 46 aa, Homo sapiens; identical to SEQ ID NO: 816124

SEQ ID NO: 816126 - protein, 542 aa, Homo sapiens
SSSPRAARAGLGAVLGGLGNRAVWRSEAPGTRGKRRAGRQPEEPRVLELGAGSWESGGERSPEPGARGGASGSGASRLDGAPAGLRHAPSPGLAFIGPRLRRAHSCPDFQPRRRRTEPRTPAPTMRLNSSAPGTPGTPAADPFQRAQAGLEEALLAPGFGNASGNASERVLAAPSSELDVNTDIYSKVLVTAVYLALFVVGTVGNTVTAFTLARKKSLQSLQSTVHYHLGSLALSDLLTLLLAMPVELYNFIWVHHPWAFGDAGCRGYYFLRDACTYATALNVASLSVERYLAICHPFKAKTLMSRSRTKKFISAIWLASALLTVPMLFTMGEQNRSADGQHAGGLVCTPTIHTATVKVVIQVNTFMSFIFPMVVISVLNTIIANKLTVMVRQAAEQGQVCTVGGEHSTFSMAIEPGRVQALRHGVRVLRAVVIAFVVCWLPYHVRRLMFCYISDEQWTPFLYDFYHYFYMVTNALFYVSSTINPILYNLVSANFRHIFLATLACLCPVWRRRRKRPAFSRKADSVSSNHTLSSNATRETLY

SEQ ID NO: 816127 - protein, 542 aa, Homo sapiens; identical to SEQ ID NO: 816126

SEQ ID NO: 816128 - protein, 784 aa, Homo sapiens
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTHYAQSLRKWNQPVSIDG

SEQ ID NO: 816129 - protein, 794 aa, Homo sapiens
PREADEMRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 816130 - protein, 794 aa, Homo sapiens; identical to SEQ ID NO: 816129

SEQ ID NO: 816131 - protein, 794 aa, Homo sapiens; identical to SEQ ID NO: 816129

SEQ ID NO: 816132 - protein, 443 aa, Homo sapiens
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVRWAGQGLCPGASVGTQPPFFLL

SEQ ID NO: 816133 - protein, 780 aa, Homo sapiens
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTVRDGAGRFLKSLV

SEQ ID NO: 816134 - protein, 443 aa, Homo sapiens; identical to SEQ ID NO: 816132

SEQ ID NO: 816135 - protein, 119 aa, Homo sapiens
AAAASVNVAAVSVSSRAPMGTPVRSAPPAQMPAPLRSECGVWREPGGWEVGEDPLTRIPSSPGVFLAHQSLRERSPLQPDGCLSFCQRLWASWNRANCEGAKVERAGLRLRMSSPRVTS

SEQ ID NO: 816136 - protein, 863 aa, Homo sapiens
QKKLRARLALAHKTFSNFIESMVLEKENTHERSPSSPKGEKGKSRLRQGSWRAFLKSKDAGSPKKPTLVSLPLGPEVLSPAETDSHCEERAEDKEGYVFSDHWAPPLASTPLSSSLVSPEHRRKSEPTIKCTATQEGDAKPDEQKEESREGGQGPRGLGTVPWLRDLPGSENHMPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 816137 - protein, 843 aa, Homo sapiens
QKKLRARLALAHKTFSNFIESMVLEKENTHERSPSSPKGEKGKSRLRQGSWRAFLKSKDAGSPKKPTLVSLPLGPEVLSPAETDSHCEERAEDKEGYVFSDHWAPPLASTPLSSSLVSPEHRRKSEPTIKCTATQEGDAKPDEQKEESREGGQGPRGLGTVPWLRDLPGSENHMPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKGRRTAAPPPRLPGPYPADIIPFSEPQSQAS

SEQ ID NO: 816138 - protein, 619 aa, Homo sapiens
MRPDGQQALDAVVRSFDCHSEAALRQRNDVIYCSLPRTAQGIVQREDQLEVLVSLREVWGRRRGRDGTCTGAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 816139 - protein, 726 aa, Homo sapiens
LRGRSPRPASAGAPPLPGRCGPPARPCAAGSRGRTEREAGRHGEGPAAPARPRGARERPARPAALQPAPRRPARGGLRRAGAPGSHQRRTDLPAGLPLSGRAGRRAGVSGAGDGTPAVATRGLRTGRGGKASFHPMCSLPGPGPGVSPSGCLRGVVARVSQGPSVLCALLGSGGCGGEGGGQNGASLRVTEDADSAGAPRLLVWKRSACDRWVSDPRLHLCRLSQLISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 816140 - protein, 233 aa, Homo sapiens
MKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 816141 - protein, 222 aa, Homo sapiens
MKNVAQLINERKRRLENIDKIAQWQSSIEDWEGEDLLVRSSELIYSGELTRVTQPQAKSQQRMFFLFDHQLIYCKKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 816142 - protein, 188 aa, Homo sapiens
LRGRSPRPASAGAPPLPGRCGPPARPCAAGSRGRTEREAGRHGEGPAAPARPRGARERPARPAALQPAPRRPARGGLRRAGAPGSHQRRTDLPAGLPLSGRAGRRAGVSGAGDGTPAVATRGLRTGRGGKASFHPMCSLPGPGPGVSPSGCLRGVVARVSQGPSVLCALWGVGAAGARGEAKMARLCE

SEQ ID NO: 816143 - protein, 608 aa, Homo sapiens
LRGRSPRPASAGAPPLPGRCGPPARPCAAGSRGRTEREAGRHGEGPAAPARPRGARERPARPAALQPAPRRPARGGLRRAGAPGSHQRRTDLPAGLPLSGRAGRRAGLISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 816144 - protein, 407 aa, Homo sapiens
MRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 816145 - protein, 462 aa, Homo sapiens
LRGRSPRPASAGAPPLPGRCGPPARPCAAGSRGRTEREAGRHGEGPAAPARPRGARERPARPAALQPAPRRPARGGLRRAGAPGSHQRRTDLPAGLPLSGRAGRRAGLISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKVPELLCPAAPS

SEQ ID NO: 816146 - protein, 41 aa, Homo sapiens
MGSTFIVCHVPVAVPSEFSITENKPAGPFCRKLKKQRELKR

SEQ ID NO: 816147 - protein, 254 aa, Homo sapiens
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKPIETKNKFSQAKLLAGAVKHKSSESGNSVKRLKPDPEPDDKNQEPSSCKSLGNTSLSGPSIHCPSAAVCIGILPGLGAYSGSSDSESSSDSEGTINATGKIVSSIFRTNTFLEAP

SEQ ID NO: 816148 - protein, 254 aa, Homo sapiens; identical to SEQ ID NO: 816147

SEQ ID NO: 816149 - protein, 254 aa, Homo sapiens; identical to SEQ ID NO: 816147

SEQ ID NO: 816150 - protein, 254 aa, Homo sapiens; identical to SEQ ID NO: 816147

SEQ ID NO: 816151 - protein, 272 aa, Homo sapiens
SGSPEVGRDSIVAIGCFIMDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKPIETKNKFSQAKLLAGAVKHKSSESGNSVKRLKPDPEPDDKNQEPSSCKSLGNTSLSGPSIHCPSAAVCIGILPGLGAYSGSSDSESSSDSEGTINATGKIVSSIFRTNTFLEAP

SEQ ID NO: 816152 - protein, 254 aa, Homo sapiens; identical to SEQ ID NO: 816147

SEQ ID NO: 816153 - protein, 254 aa, Homo sapiens; identical to SEQ ID NO: 816147

SEQ ID NO: 816154 - protein, 254 aa, Homo sapiens; identical to SEQ ID NO: 816147

SEQ ID NO: 816155 - protein, 254 aa, Homo sapiens; identical to SEQ ID NO: 816147

SEQ ID NO: 816156 - protein, 254 aa, Homo sapiens; identical to SEQ ID NO: 816147

SEQ ID NO: 816157 - protein, 254 aa, Homo sapiens; identical to SEQ ID NO: 816147

SEQ ID NO: 816158 - protein, 254 aa, Homo sapiens; identical to SEQ ID NO: 816147

SEQ ID NO: 816159 - protein, 254 aa, Homo sapiens; identical to SEQ ID NO: 816147

SEQ ID NO: 816160 - protein, 254 aa, Homo sapiens; identical to SEQ ID NO: 816147

SEQ ID NO: 816161 - protein, 254 aa, Homo sapiens; identical to SEQ ID NO: 816147

SEQ ID NO: 816162 - protein, 254 aa, Homo sapiens; identical to SEQ ID NO: 816147

SEQ ID NO: 816163 - protein, 177 aa, Homo sapiens
MVRGLDEDETNFLDEVSRQQELIEKQRREEELKELKEYRNNLKKVGISQENKKEVEKKLTVKPIETKNKFSQAKLLAGAVKHKSSESGNSVKRLKPDPEPDDKNQEPSSCKSLGNTSLSGPSIHCPSAAVCIGILPGLGAYSGSSDSESSSDSEGTINATGKIVSSIFRTNTFLEAP

SEQ ID NO: 816164 - protein, 254 aa, Homo sapiens; identical to SEQ ID NO: 816147

SEQ ID NO: 816165 - protein, 223 aa, Homo sapiens
MDGGDDGNLIIKKRFVSEAELDERRKRRQEEWEKVRKPEDPEECPEEVYDPRSLYERLQEQKDRKQQEYEEQFKFKNMFDPTGTHNNLKKVGISQENKKEVEKKLTVKPIETKNKFSQAKLLAGAVKHKSSESGNSVKRLKPDPEPDDKNQEPSSCKSLGNTSLSGPSIHCPSAAVCIGILPGLGAYSGSSDSESSSDSEGTINATGKIVSSIFRTNTFLEAP

SEQ ID NO: 816166 - protein, 260 aa, Homo sapiens
SGSPEVGRDSIVAIGCFIMDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKPIETKNKFSQAKLLAGAVKHKSSESGNSVCKEPSSCKSLGNTSLSGPSIHCPSAAVCIGILPGLGAYSGSSDSESSSDSEGTINATGKIVSSIFRTNTFLEAP

SEQ ID NO: 816167 - protein, 211 aa, Homo sapiens
RRMGRRGEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKPIETKNKFSQAKLLAGAVKHKSSESGNSVCKEPSSCKSLGNTSLSGPSIHCPSAAVCIGILPGLGAYSGSSDSESSSDSEGTINATGKIVSSIFRTNTFLEAP

SEQ ID NO: 816168 - protein, 270 aa, Homo sapiens
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKPIETKNKFSQAKLLAGAVKHKSSESGNSVKRLKPDPEPDDKNQEPSSCKSLGNTSLSGPSIHCPSAAVCIGILPGLGAYSGSSDSESSSDSEGTINATGKIVSSIFRTNTFLEAPLIFFPAPSTRGSFLSP

SEQ ID NO: 816169 - protein, 242 aa, Homo sapiens
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKPIETKNKFSQAKLLAGAVKHKSSESGNSVKRLKPDPEPDDKNQEPSSCKSLGNTSLSGPSIHCPSAAHKEVRAVIGQVLFKHSIVNECVVWFYCIVEHAGEEN

SEQ ID NO: 816170 - protein, 273 aa, Homo sapiens
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKPIETKNKFSQAKLLAGAVKHKSSESGNSVKRLKPDPEPDDKNQEPSSCKSLGNTSLSGPSIHCPSAAVCIGILPGLGAYSGSSDSESSSDSEGTINATGKIVSSIFRTNFLRPSFRLREPPRVMGGRAKVLSKK

SEQ ID NO: 816171 - protein, 294 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 816172 - protein, 318 aa, Homo sapiens
LQLQQLEGEVKETPFRFPSSRGLAMATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 816173 - protein, 277 aa, Homo sapiens
GSPKKPLRHTTQHSKAVTPRFPSSRGLAMATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVHAGAALRGSLFRTVVEILPFVTCLPRSLASFGCANIVVLVLWERPAWGGPPGGA

SEQ ID NO: 816174 - protein, 238 aa, Homo sapiens
PPTDGGSPPAGPGRCRSTWPLWSRFPSSRGLAMATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTRLRGTEL

SEQ ID NO: 816175 - protein, 104 aa, Homo sapiens [sequence omitted]

SEQ ID NO: 816176 - protein, 202 aa, Homo sapiens
INAECPLWPGARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNEWGEIGRDPFYPEKFCGKIL

SEQ ID NO: 816177 - protein, 294 aa, Homo sapiens; identical to SEQ ID NO: 816171

SEQ ID NO: 816178 - protein, 294 aa, Homo sapiens; identical to SEQ ID NO: 816171

SEQ ID NO: 816179 - protein, 294 aa, Homo sapiens; identical to SEQ ID NO: 816171

SEQ ID NO: 816180 - protein, 294 aa, Homo sapiens; identical to SEQ ID NO: 816171

SEQ ID NO: 816181 - protein, 294 aa, Homo sapiens; identical to SEQ ID NO: 816171

SEQ ID NO: 816182 - protein, 294 aa, Homo sapiens; identical to SEQ ID NO: 816171

SEQ ID NO: 816183 - protein, 294 aa, Homo sapiens; identical to SEQ ID NO: 816171

SEQ ID NO: 816184 - protein, 294 aa, Homo sapiens; identical to SEQ ID NO: 816171

SEQ ID NO: 816185 - protein, 246 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISV

SEQ ID NO: 816186 - protein, 335 aa, Homo sapiens
RWPRCPAALAPLCPGSPFGPLTPAYRTSCPSRRFPSSRGLAMATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 816187 - protein, 322 aa, Homo sapiens
GSPKKPLRHTTQHSKAVTPRFPSSRGLAMATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 816188 - protein, 317 aa, Homo sapiens
GTRITFNGPPQDTTRFPSSRGLAMATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 816189 - protein, 319 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPAGVKLNSLSGRWEEHNVGKGGRLEWRLSVKNLDGSEIGKIHGEKGFSRKIKGSEG

SEQ ID NO: 816190 - protein, 296 aa, Homo sapiens
TLEDSRRRTMARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 816191 - protein, 273 aa, Homo sapiens
RGSAYVWTHQEDCFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 816192 - protein, 282 aa, Homo sapiens
PIQATWICHCFSRECLGEAGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 816193 - protein, 234 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDALQLNISWIPLLPFLQKSTTLA

SEQ ID NO: 816194 - protein, 255 aa, Homo sapiens
MLVIPATQEAEEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 816195 - protein, 255 aa, Homo sapiens; identical to SEQ ID NO: 816194

SEQ ID NO: 816196 - protein, 283 aa, Homo sapiens
MCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 816197 - protein, 104 aa, Homo sapiens [sequence omitted]

SEQ ID NO: 816198 - protein, 227 aa, Homo sapiens
ESALYLNIRVYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 816199 - protein, 185 aa, Homo sapiens
DAWVDPRVRGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 816200 - protein, 184 aa, Homo sapiens
MTPSAPIRGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 816201 - protein, 123 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGPNQS

SEQ ID NO: 816202 - protein, 206 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTRLRGTEL

SEQ ID NO: 816203 - protein, 216 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNEWGEIGRDPFYPEKFCGKIL

SEQ ID NO: 816204 - protein, 195 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNV

SEQ ID NO: 816205 - protein, 156 aa, Homo sapiens
MLVIPATQEAEEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNV

SEQ ID NO: 816206 - protein, 85 aa, Homo sapiens
PGGQRRGPVWERTGLRRAERCLLHFALQLLQLQPDRERAKRLQQLAERWRRPPSGHHQIPLFPRPRHGDPRTDLRASNVYSSIIC

SEQ ID NO: 816207 - protein, 108 aa, Homo sapiens
MADPRVRQIKIKTGVVKRLVKEKVMYEKEAKQQEEKIEKMRAEDGENYDIKKQAEILQESRMMIPDCQRRLEAAYLDLQRILENEKDLEEAEEYKEARLVLDSVKLEA

SEQ ID NO: 816208 - protein, 66 aa, Homo sapiens
HARRRPRLNSRSLCASPSTVTPALRPSFSRRSRDHGRSSRETDQDQDRRGEARRGLNMLPSLVWNS

SEQ ID NO: 816209 - protein, 110 aa, Homo sapiens
GAPGPGQPGSVFMMRFGTRMLVKEKVMYEKEAKQQEEKIEKMRAEDGENYDIKKQAEILQESRMMIPDCQRRLEAAYLDLQRILENEKDLEEAEEYKEARLVLDSVKLEA

SEQ ID NO: 816210 - protein, 108 aa, Homo sapiens; identical to SEQ ID NO: 816207

SEQ ID NO: 816211 - protein, 133 aa, Homo sapiens
VKDHNMKKKSGAVAAVPLLRLVKEKVMYEKEAKQQEEKIEKMRAEDGENYDIKKQAGLQLLASSDPPTPASQSPGMISAEILQESRMMIPDCQRRLEAAYLDLQRILENEKDLEEAEEYKEARLVLDSVKLEA

SEQ ID NO: 816212 - protein, 129 aa, Homo sapiens
MADPRVRQIKIKTGVVKRLVKEKVMYEKEAKQQEEKIEKMRAEDGENYDIKKQAEILQESRMMIPDCQRRLEAAYLDLQRILVSKDFCVMFKFFFSIQYMESQKFKYLTLRTSWQYFLFTCPLYRYILK

SEQ ID NO: 816213 - protein, 163 aa, Homo sapiens
MADPRVRQIKIKTGVVKRLVKEKVMYEKEAKQQEEKKKKKKKLVCGGARLGPLRERFLEDTHSGVGARGGPRGLGEPGPKSAGAKRRETAGAMRDKRRGASSLTKYYIKKARAGGEHQRGVFLRTKLPKSGGTREGPIHGRLISTGERYQGETSHIKNIRPGA

SEQ ID NO: 816214 - protein, 108 aa, Homo sapiens; identical to SEQ ID NO: 816207

SEQ ID NO: 816215 - protein, 108 aa, Homo sapiens; identical to SEQ ID NO: 816207

SEQ ID NO: 816216 - protein, 116 aa, Homo sapiens
MRAGDHAYIAAASARRPPRLPRLSAPPSRGARGTMADPRVRQIKIKTGVVKRLVKEKVMYEKEAKQQEEKIEKMRAEDGENYDIKKQAEILQESRMMIPDCQRRLEAAYLDLQRIL

SEQ ID NO: 816217 - protein, 102 aa, Homo sapiens
MADPRVRQIKIKTGVVKRLVKEKVMYEKEAKQQEEKIEKMRAEDGENYDIKKQAEILQESRMMIPDCQRRLEAAYLDLQRILEMKKTWWKLRSNKEHALDTE

SEQ ID NO: 816218 - protein, 108 aa, Homo sapiens; identical to SEQ ID NO: 816207

SEQ ID NO: 816219 - protein, 122 aa, Homo sapiens
LGIMLTRTSWFHGFFSWFSSSICWSTLSKFLRLVKEKVMYEKEAKQQEEKIEKMRAEDGENYDIKKQAEILQESRMMIPDCQRRLEAAYLDLQRILENEKDLEEAEEYKEARLVLDSVKLEA

SEQ ID NO: 816220 - protein, 112 aa, Homo sapiens
GRPTWPAVSGLFTGWGLENQILLVKEKVMYEKEAKQQEEKIEKMRAEDGENYDIKKQAEILQESRMMIPDCQRRLEAAYLDLQRILENEKDLEEAEEYKEARLVLDSVKLEA

SEQ ID NO: 816221 - protein, 112 aa, Homo sapiens; identical to SEQ ID NO: 816220

SEQ ID NO: 816222 - protein, 71 aa, Homo sapiens
GGAVWKEFWFQLRAYLAEILQESRMMIPDCQRRLEAAYLDLQRILENEKDLEEAEEYKEARLVLDSVKLEA

SEQ ID NO: 816223 - protein, 139 aa, Homo sapiens
GAQVYFSLQTCFCGPQRDGEPGGCGKKSLGFQGRIFSRPRKEKPLPRERLVKEKVMYEKEAKQQEEKIEKMRAEDGENYDIKKQAEILQESRMMIPDCQRRLEAAYLDLQRILENEKDLEEAEEYKEARLVLDSVKLEA

SEQ ID NO: 816224 - protein, 108 aa, Homo sapiens; identical to SEQ ID NO: 816207

SEQ ID NO: 816225 - protein, 108 aa, Homo sapiens; identical to SEQ ID NO: 816207

SEQ ID NO: 816226 - protein, 51 aa, Homo sapiens
ASRNTTLRIMNPQCHSEEKSLVIAEQFLPQRLMYLPTPNHDFTLPKAHVLM

SEQ ID NO: 816227 - protein, 376 aa, Homo sapiens
MESYDIIANQPVVIDNGSGVIKAGFAGDQIPKYCFPNYVGRPKHMRVMAGALEGDLFIGPKAEEHRGLLTIRYPMEHGVVRDWNDMERIWQYVYSKDQLQTFSEEHPVLLTEAPLNPSKNREKAAEVFFETFNVPALFISMQAVLSLYATGRTTGVVLDSGDGVTHAVPIYEGFAMPHSIMRVDIAGRDVSRYLRLLLRKEGVDFHTSAEFEVVRTIKERACYLSINPQKDEALETEKVQYTLPDGSTLDVGPARFRAPELLFQPDLVGDESEGLHEVVAFAIHKSDMDLRRTLFANIVLSGGSTLFKGFGDRLLSEVKKLAPKDIKIKISAPQERLYSTWIGGSILASLDTFKKMWVSKKEYEEDGSRAIHRKTF

SEQ ID NO: 816228 - protein, 376 aa, Homo sapiens; identical to SEQ ID NO: 816227

SEQ ID NO: 816229 - protein, 454 aa, Homo sapiens
MESYDIIANQPVVIDNGSGVIKAGFAGDQIPKYCFPNYVGRPKHMRVMAGALEGDLFIGPKAEEHRGLLTIRYPMEHGVVRDWNDMERIWQYVYSKDQLQTFSEEHPVLLTEAPLNPSKNREKAAEVFFETFNVPALFISMQAVLSLWVLPKPGLPESCPPCAVLLAMTRVCLPWKNSPLMTVPLGSPSCPLFRLDNADVPGFLPWVRGPRASVAEVRGCCPGDRYATGRTTGVVLDSGDGVTHAVPIYEGFAMPHSIMRVDIAGRDVSRYLRLLLRKEGVDFHTSAEFEVVRTIKERACYLSINPQKDEALETEKVQYTLPDGSTLDVGPARFRAPELLFQPDLVGDESEGLHEVVAFAIHKSDMDLRRTLFANIVLSGGSTLFKGFGDRLLSEVKKLAPKDIKIKISAPQERLYSTWIGGSILASLDTFKKMWVSKKEYEEDGSRAIHRKTF

SEQ ID NO: 816230 - protein, 266 aa, Homo sapiens
MESYDIIANQPVVIDNGSGVIKAGFAGDQIPKYCFPNYVGRPKHMRVMAGALEGDLFIGPKAEEHRGLLTIRYPMEHGVVRDWNDMERIWQYVYSKDQLQTFSEEHPVLLTEAPLNPSKNREKAAEVFFETFNVPALFISMQAVLSLARKGLTSIPRLSLRLSGQSKSERATCPSTHRRMRLWRRRRCSTRCQTAARLMWGLHDSGPPSCCSSRTLWGMRVRGSMRWWPSPYTSPTWTCAGRCSPTSCSQVAQRFSKASETDYSVK

SEQ ID NO: 816231 - protein, 376 aa, Homo sapiens; identical to SEQ ID NO: 816227

SEQ ID NO: 816232 - protein, 142 aa, Homo sapiens
YKDRPISDCLLPAANRSCKVELQERIKAEEQRRADVQDRLERTMRAMHMTKEALEHLASKLDHITVADSAPEEAPPRAPQDVRGSSTITQVDSRPKVHSREPTPCPVQYMRGPNTGETPTCSAGPCTRISAPQERLYSTWIG

SEQ ID NO: 816233 - protein, 376 aa, Homo sapiens; identical to SEQ ID NO: 816227

SEQ ID NO: 816234 - protein, 376 aa, Homo sapiens; identical to SEQ ID NO: 816227

SEQ ID NO: 816235 - protein, 376 aa, Homo sapiens; identical to SEQ ID NO: 816227

SEQ ID NO: 816236 - protein, 376 aa, Homo sapiens; identical to SEQ ID NO: 816227

SEQ ID NO: 816237 - protein, 376 aa, Homo sapiens; identical to SEQ ID NO: 816227

SEQ ID NO: 816238 - protein, 343 aa, Homo sapiens
MESYDIIANQPVVIDNGSGVIKAGFAGDQIPKYCFPNYVGRPKHMRVMAGALEGDLFIGPKAEEHRGLLTIRYPMEHGVVRDWNDMERIWQYVYSKDQLQTFSEEHPVLLTEAPLNPSKNREKAAEVFFETFNVPALFISMQAVLSLYATGRTTGVVLDSGDGVTHAVPIYEGFAMPHSIMRVDIAGRDVSRYLRLLLRKEGVDFHTSAEFEVVRTIKERACYLSINPQKDEALETEKVQYTLPDGSTLDVGPARFRAPELLFQPDLVGDESEGLHEVVAFAIHKSDMDLRRTLFANIVLSGGSTLFKGFGDRLLSEVKKLAPKDIKIKISAPQERLYSTWIG

SEQ ID NO: 816239 - protein, 347 aa, Homo sapiens
MESYDIIANQPVVIDNGSGVIKAGFAGDQIPKYCFPNYVGRPKHMRVMAGALEGDLFIGPKAEEHRGLLTIRYPMEHGVVRDWNDMERIWQYVYSKDQLQTFSEEHPVLLTEAPLNPSKNREKAAEVFFETFNVPALFISMQAVLSLYATGRTTGVVLDSGDGVTHAVPIYEGFAMPHSIMRVDIAGRDVSRYLRLLLRKEGVDFHTSAEFEVVRTIKERACYLSINPQKDEALETEKVQYTLPDGSTLDVGPARFRAPELLFQPDLVGDESEGLHEVVAFAIHKSDMDLRRTLFARAEDARWLEPLHYPFQSTSSTCSSLYPRHPGWERVDAHHLLRGSHLIRSQT

SEQ ID NO: 816240 - protein, 128 aa, Homo sapiens
MESYDIIANQPVVIDNGSGVIKAGFAGDQIPKYCFPNYVGRPKHMRVMAGALEGDLFIGPKAEEHRGLLTIRYPMEHGVVRDWNDMERIWQYVYSKDQLQTFSEEHPVLLTEAPAQPTELIIFYIFFW

SEQ ID NO: 816241 - protein, 35 aa, Homo sapiens
DWNDMERIWQYVYSKDQLQTFSEEVWRLPLLHALH

SEQ ID NO: 816242 - protein, 1807 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQDGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGPPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 816243 - protein, 246 aa, Homo sapiens
MQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 816244 - protein, 222 aa, Homo sapiens
RGSGIEWHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 816245 - protein, 1611 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQDGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGPPGPPGEVIQPLPILSSKKTRRHTEGMQADADDNILDYSDGMEEIFGSLNSLKQDIEHMKFPMGTQTNPFCATCKF

SEQ ID NO: 816246 - protein, 273 aa, Homo sapiens [sequence omitted]

SEQ ID NO: 816247 - protein, 738 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGMAGVDGPPGPKGNMGPQGEPGPPGQQGNPGPQGLPGPQGPIGPPGEKVSFSFSLFYKKVIKFACDKRFVGRHDERKVVKLSLPLYLIYE

SEQ ID NO: 816248 - protein, 108 aa, Homo sapiens
MTPLRRGQSPPAEKRLKGDAWRDGGGPTRGPAARAAVLALLLLLLAPLPPGAPPGADAYFPEERWSPESPLQAPRVLIALLARNAAHALPTTLGALERLRHPRERTAL

SEQ ID NO: 816249 - protein, 622 aa, Homo sapiens
MAAAPRAGRRRGQPLLALLLLLLAPLPPGAPPGADAYFPEERWSPESPLQAPRVLIALLARNAAHALPTTLGALERLRHPRERTALWVATDHNMDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAVPMVHSTFLIDLRKAASRNLAFYPPHPDYTWSFDDIIVFAFSCKQAEVQMYVCNKEEYGFLPVPLRAHSTLQDEAESFMHVQLEVMVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTLAYVISLQGARKLLAAEPLSKMLPVDEFLPVMFDKHPVSEYKAHFSLRNLHAFSVEPLLIYPTHYTGDDGYVSDTETSVVWNNEHVKTDWDRAKSQKMREQQALSREAKNSDVLQSPLDSAARDEL

SEQ ID NO: 816250 - protein, 507 aa, Homo sapiens
RGFLAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAVPMVHSTFLIDLRKAASRNLAFYPPHPDYTWSFDDIIVFAFSCKQAEVQMYVCNKEEYGFLPVPLRAHSTLQDEAESFMHVQLEVMVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTLAYVISLQGARKLLAAEPLSKMLPVDEFLPVMFDKHPVSEYKAHFSLRNLHAFSVEPLLIYPTHYTGDDGYVSDTETSVVWNNEHVKTDWDRAKSQKMREQQALSREAKNSDVLQSPLDSAARDEL

SEQ ID NO: 816251 - protein, 622 aa, Homo sapiens; identical to SEQ ID NO: 816249

SEQ ID NO: 816252 - protein, 151 aa, Homo sapiens
MQVEHPEKAVPRVRNLVEADYSYWTLAYVISLQGARKLLAAEPLSKMLPVDEFLPVMFDKHPVSEYKAHFSLRNLHAFSVEPLLIYPTHYTGDDGYVSDTETSVVWNNEHVKTDWDRAKSQKMREQQALSREAKNSDVLQSPLDSAARDEL

SEQ ID NO: 816253 - protein, 105 aa, Homo sapiens
MLPVDEFLPVMFDKHPVSEYKAHFSLRNLHAFSVEPLLIYPTHYTGDDGYVSDTETSVVWNNEHVKTDWDRAKSQKMREQQALSREAKNSDVLQSPLDSAARDEL

SEQ ID NO: 816254 - protein, 463 aa, Homo sapiens
MAAAPRAGRRRGQPLLALLLLLLAPLPPGAPPGADAYFPEERWSPESPLQAPRVLIALLARNAAHALPTTLGALERLRHPRERTALWVATDHNMDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAVPMVHSTFLIDLRKAASRNLAFYPPHPDYTWSFDDIIVFAFSCKQAVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTSAARDEL

SEQ ID NO: 816255 - protein, 622 aa, Homo sapiens; identical to SEQ ID NO: 816249

SEQ ID NO: 816256 - protein, 488 aa, Homo sapiens
MAAAPRAGRRRGQPLLALLLLLLAPLPPGAPPGADAYFPEERWSPESPLQAPRVLIALLARNAAHALPTTLGALERLRHPRERTALWVATDHNMDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAVPMVHSTFLIDLRKAASRNLAFYPPHPDYTWSFDDIIVFAFSCKQAEVQMYVCNKEEYGFLPVPLRAHSTLQDEAESFMHVQLEVMVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIMTSCTCMKLSASSWRVLARNGTG

SEQ ID NO: 816257 - protein, 352 aa, Homo sapiens
MAAAPRAGRRRGQPLLALLLLLLAPLPPGAPPGADAYFPEERWSPESPLQAPRVLIALLARNAAHALPTTLGALERLRHPRERTALWVATDHNMDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAVPMVHSTFLIDLRKAASRNLAFYPPHPDYTWSFDDIIVFAFSCKQAEVQMYVCNKEEYGFLPVPLRAHSTLQDEAESFMHVQLEVMAPAPEPSRFIARPGRRPGAEGKARLILIFSTNTDGH

SEQ ID NO: 816258 - protein, 161 aa, Homo sapiens
PQWEGGRQEQHEPPVPSSPQDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816259 - protein, 188 aa, Homo sapiens
MCFPKVLSDDMKKLKARMHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816260 - protein, 85 aa, Homo sapiens
MCFPKVLSDDMKKLKARMHQAIERFYDKMQNAESGRGQVMSSLAELEDDFKEGYLETVAAYYEEQHPELTSLLVRILPDEPWEAL

SEQ ID NO: 816261 - protein, 109 aa, Homo sapiens
MCFPKVLSDDMKKLKARMVMLLPTSAQGLGAWVSACDTEDTVGHLGPWRDKDPALWCQLCLSSQHQAIERFYDKMQNAESGRGQVGGFPLRHQVTCPRPQALHPVWGSG

SEQ ID NO: 816262 - protein, 102 aa, Homo sapiens
ELPQPAVPSLDFPSAPPHSQAGGVGKAAHSWAQRLPPQLRGSRGPARDGPSFLPGTPDLCLSRVSLHLCLSLSLSLSLSVFHALSKASCPERGSAHYPPLSP

SEQ ID NO: 816263 - protein, 261 aa, Homo sapiens
GVAPASCPESGLSLCPSPLSGWWGGESSPFLGSETPTPAQREQGPSQGRTLIPPRDPRPLSLSGPWLLELLAAMCFPKVLSDDMKKLKARMHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816264 - protein, 188 aa, Homo sapiens; identical to SEQ ID NO: 816259

SEQ ID NO: 816265 - protein, 188 aa, Homo sapiens; identical to SEQ ID NO: 816259

SEQ ID NO: 816266 - protein, 261 aa, Homo sapiens; identical to SEQ ID NO: 816263

SEQ ID NO: 816267 - protein, 261 aa, Homo sapiens; identical to SEQ ID NO: 816263

SEQ ID NO: 816268 - protein, 234 aa, Homo sapiens
MCFPKVLSDDMKKLKARMVMLLPTSAQGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816269 - protein, 188 aa, Homo sapiens; identical to SEQ ID NO: 816259

SEQ ID NO: 816270 - protein, 188 aa, Homo sapiens; identical to SEQ ID NO: 816259

SEQ ID NO: 816271 - protein, 188 aa, Homo sapiens; identical to SEQ ID NO: 816259

SEQ ID NO: 816272 - protein, 307 aa, Homo sapiens
GVAPASCPESGLSLCPSPLSGWWGGESSPFLGSETPTPAQREQGPSQGRTLIPPRDPRPLSLSGPWLLELLAAMCFPKVLSDDMKKLKARMVMLLPTSAQGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816273 - protein, 188 aa, Homo sapiens; identical to SEQ ID NO: 816259

SEQ ID NO: 816274 - protein, 188 aa, Homo sapiens; identical to SEQ ID NO: 816259

SEQ ID NO: 816275 - protein, 234 aa, Homo sapiens; identical to SEQ ID NO: 816268

SEQ ID NO: 816276 - protein, 212 aa, Homo sapiens
MCFPKGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816277 - protein, 168 aa, Homo sapiens
MCFPKVLSDDMKKLKARMVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816278 - protein, 163 aa, Homo sapiens
RGSLARWKSGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816279 - protein, 168 aa, Homo sapiens; identical to SEQ ID NO: 816277

SEQ ID NO: 816280 - protein, 149 aa, Homo sapiens [sequence omitted]

SEQ ID NO: 816281 - protein, 149 aa, Homo sapiens [sequence omitted]

SEQ ID NO: 816282 - protein, 184 aa, Homo sapiens
MCQSRRRTCLLLKVWREKAGGRTGFKEFNPDVGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816283 - protein, 182 aa, Homo sapiens
ELGHLRPSFELLAAMCFPEVLSDDMKKLKARMVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816284 - protein, 225 aa, Homo sapiens
MCFPKVLSDDMKKLKARMVMLLPTSAQGLGAWVSACDTEDTVGHLGPWRDKDPALWCQLCLSSQHQAIERFYDKMQNAESGRGQDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816285 - protein, 161 aa, Homo sapiens; identical to SEQ ID NO: 816258

SEQ ID NO: 816286 - protein, 159 aa, Homo sapiens
MCFPKVLSDDMKKLKARMDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816287 - protein, 188 aa, Homo sapiens; identical to SEQ ID NO: 816259

SEQ ID NO: 816288 - protein, 188 aa, Homo sapiens; identical to SEQ ID NO: 816259

SEQ ID NO: 816289 - protein, 127 aa, Homo sapiens
MRSSTQKLTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816290 - protein, 153 aa, Homo sapiens
VDELSNRRVIVNELVGGAGDRWLAYDEALLTHKLTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 816291 - protein, 261 aa, Homo sapiens; identical to SEQ ID NO: 816263

SEQ ID NO: 816292 - protein, 168 aa, Homo sapiens; identical to SEQ ID NO: 816277

SEQ ID NO: 816293 - protein, 261 aa, Homo sapiens; identical to SEQ ID NO: 816263

SEQ ID NO: 816294 - protein, 261 aa, Homo sapiens; identical to SEQ ID NO: 816263

SEQ ID NO: 816295 - protein, 252 aa, Homo sapiens
GVAPASCPESGLSLCPSPLSGWWGGESSPFLGSETPTPAQREQGPSQGRTLIPPRDPRPLSLSGPWLLELLAAMCFPKVLSDDMKKLKARMHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFHLGPVQSLGPVQSLGP

SEQ ID NO: 816296 - protein, 198 aa, Homo sapiens
GVAPASCPESGLSLCPSPLSGWWGGESSPFLGSETPTPAQREQGPSQGRTLIPPRDPRPLSLSGPWLLELLAAMCFPKVLSDDMKKLKARMHQAIERFYDKMQNAESGRGQVMSSLAELEDDFKEGYLETVAAYYEEQHPELTPLLEKERDGLRCRGNRSPVPDVEDPATEEPGESFCDKVLRSPTGGQGGADTPEVL

SEQ ID NO: 816297 - protein, 125 aa, Homo sapiens
MCFPKVLSDDMKKLKARMHQAIERFYDKMQNAESGRGQVMSSLAELEDDFKEGYLETVAAYYEEQHPELTPLLEKERDGLRCRGNRSPVPDVEDPATEEPGESFCDKVLRSPTGGQGGADTPEVL

SEQ ID NO: 816298 - protein, 221 aa, Homo sapiens
GVAPASCPESGLSLCPSPLSGWWGGESSPFLGSETPTPAQREQGPSQGRTLIPPRDPRPLSLSGPWLLELLAAMCFPKVLSDDMKKLKARMHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGPVIPDTQEAEAGESLEPGRQRLQ

SEQ ID NO: 816299 - protein, 204 aa, Homo sapiens
GVAPASCPESGLSLCPSPLSGWWGGESSPFLGSETPTPAQREQGPSQGRTLIPPRDPRPLSLSGPWLLELLAAMCFPKVLSDDMKKLKARMHQAIERFYDKMQNAESGRGQVMSSLAELEDDFKEGYLETVAAYYEEQHPELTPLLEKERDGLRCRGNRSPVPDVEDPATEEPGESFCDKVMRWFQVLRSPTGGQGGADTPEVL

SEQ ID NO: 816300 - protein, 107 aa, Homo sapiens
MTDVGCRGGLGLEPSALFLTVMSSLAELEDDFKEGYLETVAAYYEEQHPELTPLLEKERDGLRCRGNRSPVPDVEDPATEEPGESFCDKVLRSPTGGQGGADTPEVL

SEQ ID NO: 816301 - protein, 121 aa, Homo sapiens
MCFPKVLSDDMKKLKARMVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVAIIPKI

SEQ ID NO: 816302 - protein, 184 aa, Homo sapiens
MAAAGGARLLRAASAVLGGPAGRWLHHAGSRAGSSGLLRNRGPGGSAEASRSLSVSARARSSSEDKITVHFINRDGETLTTKGKVGDSLLDVVVENNLDIDGFGACEGTLACSTCHLIFEDHIYEKLDAITDEENDMLDLAYGLTDRSRLGCQICLTKSMDNMTVRVPETVADARQSIDVGKTS

SEQ ID NO: 816303 - protein, 184 aa, Homo sapiens; identical to SEQ ID NO: 816302

SEQ ID NO: 816304 - protein, 184 aa, Homo sapiens; identical to SEQ ID NO: 816302

SEQ ID NO: 816305 - protein, 184 aa, Homo sapiens; identical to SEQ ID NO: 816302

SEQ ID NO: 816306 - protein, 164 aa, Homo sapiens
MAAAGGARLLRAASAVLGGPAGRWLHHAGSRAGSSGLLRNRGPGGSAEASRSLSVSARARSSSEDKITVHFINRDGETLTTKGKVGDSLLDVVVENNLDIDGFGACEGTLACSTCHLIFEDHIYEKLDAITDEENDMLDLAYGLTDRSRLGCQICLTIDVGKTS

SEQ ID NO: 816307 - protein, 186 aa, Homo sapiens
MAAAGGARLLRAASAVLGGPAGRWLHHAGSRAGSSGLLRNRGPGGSAEASRSLSVSARARSSSEDKITVHFINRDGETLTTKGKVGDSLLDVVVENNLDIDGFGACEGTLACSTCHLIFEDHIYEKLDAITDEENDMLDLAYGLTDRSRLGCQICLTKSMDNMTVRVPETVADARQSYFYNYYFLK

SEQ ID NO: 816308 - protein, 118 aa, Homo sapiens
MAAAGGARLLRAASAVLGGPAGRWLHHAGSRAGSSGLLRNRGPGGSAEASRSLSVSARARSSSEDKITVHFINRDGETLTTKGKVGDSLLDVVVENNLDIDGFEQPLSCLTLGTLPMG

SEQ ID NO: 816309 - protein, 369 aa, Homo sapiens
MTLEAIRYSRGSLQILDQLLLPKQSRYEAVGSVHQAWEAIRAMKVRGAPAIALVGCLSLAVELQAGAGGPGLAALVAFVRDKLSFLVTARPTAVNMARAARDLADVAAREAEREGATEEAVRERVICCTEDMLEKDLRDNRSIGDLGARHLLERVAPSGGKVTVLTHCNTGALATAGYGTALGVIRSLHSLGRLEHAFCTETRPYNQGARLTAFELVYEQIPATLITDSMVAAAMAHRGVSAVVVGADRVVANGDTANKVGTYQLAIVAKHHGIPFYVAAPSSSCDLRLETGKEIIIEERPGQELTDVNGVRIAAPGIGVWNPAFDVTPHDLITGGIITELGVFAPEELRTALTTTISSRDGTLDGPQM

SEQ ID NO: 816310 - protein, 369 aa, Homo sapiens; identical to SEQ ID NO: 816309

SEQ ID NO: 816311 - protein, 369 aa, Homo sapiens; identical to SEQ ID NO: 816309

SEQ ID NO: 816312 - protein, 369 aa, Homo sapiens; identical to SEQ ID NO: 816309

SEQ ID NO: 816313 - protein, 436 aa, Homo sapiens
MTLEAIRYSRGSLQILDQLLLPKQSRYEAVGSVHQAWEAIRAMKVRGAPAIALVGCLSLAVELQAGAGGPGLAALVAFVRDKLSFLVTARPTAVNMARAARDLADVAAREAEREGATEEAVRERVICCTEDMLEKDLRDNRSIGDLGARHLLERVAPSGGKVTVLTHCNTGALATAGYGTALDVKRSYASIGKSIPGRGNCHCEGPWAGLCSVSLWQSTPRLGACTPNQWTTLSVCPSPGPSPGGWGPRRCDSLTAQPGPLEHAFCTETRPYNQGARLTAFELVYEQIPATLITDSMVAAAMAHRGVSAVVVGADRVVANGDTANKVGTYQLAIVAKHHGIPFYVAAPSSSCDLRLETGKEIIIEERPGQELTDVNGVRIAAPGIGVWNPAFDVTPHDLITGGIITELGVFAPEELRTALTTTISSRDGTLDGPQM

SEQ ID NO: 816314 - protein, 351 aa, Homo sapiens
MTLEAIRYSRGSLQILDQLLLPKQSRYEAVGSVHQAWEAIRAMKVRGAPAIALVGCLSLAVELQAGAGGPGLAALVAFVRDKLSFLVTARPTAVNMARAARDLADVAAREAEREGATEEAVRERVICCTEDMLEKDLRDNRSIGDLGARHLLERVAPSGGKVTVLTHCNTGALATAGYGTALGVIRSLHSLGRLEHAFCTETRPYNQGARLTAFELVYEQIPATLITDSMVAAAMAHRGVSAVVVGADRVVANGDTANKVGTYQLAIVAKHHGIPFYVAAPSSSCDLRLETGKEIIIEERPGQELTDVNGVRIAAPGIGVWNPAFDVTPHDLITGGIITELGVFAPEEPPE

SEQ ID NO: 816315 - protein, 369 aa, Homo sapiens; identical to SEQ ID NO: 816309

SEQ ID NO: 816316 - protein, 140 aa, Homo sapiens [sequence omitted]

SEQ ID NO: 816317 - protein, 374 aa, Homo sapiens
MTLEAIRYSRGSLQILDQLLLPKQSRYEAVGSVHQAWEAIRAMKVRGAPAIALVGCLSLAVELQAGAGGPGLAALVAFVRDKLSFLVTARPTAVNMARAARDLADVAAREAEREGATEEAVRERVICCTEDMLEKDLRDNRSIGDLGARHLLERVAPSGGKVTVLTHCNTGALATAGYGTALDVKRSYASIGKSIPGRGNCHCEGPWAGLCSGARLTAFELVYEQIPATLITDSMVAAAMAHRGVSAVVVGADRVVANGDTANKVGTYQLAIVAKHHGIPFYVAAPSSSCDLRLETGKEIIIEERPGQELTDVNGVRIAAPGIGVWNPAFDVTPHDLITGGIITELGVFAPEELRTALTTTISSRDGTLDGPQM

SEQ ID NO: 816318 - protein, 369 aa, Homo sapiens; identical to SEQ ID NO: 816309

SEQ ID NO: 816319 - protein, 415 aa, Homo sapiens
MTLEAIRYSRGSLQILDQLLLPKQSRYEAVGSVHQAWEAIRAMKVRGAPAIALVGCLSLAVELQAGAGGPGLAALVAFVRDKLSFLVTARPTAVNMARAARDLADVAAREAEREGATEEAVRERVICCTEDMLEKDLRDNRSIGDLGARHLLERVAPSGGKTVKRSYASIGKSIPGRGNCHCEGPWAGLCSVSLWQSTPRLGACTPNQWTTLSVCPSPGPSPGGWGPRRCDSLTAQPGPLEHAFCTETRPYNQGARLTAFELVYEQIPATLITDSMVAAAMAHRGVSAVVVGADRVVANGDTANKVGTYQLAIVAKHHGIPFYVAAPSSSCDLRLETGKEIIIEERPGQELTDVNGVRIAAPGIGVWNPAFDVTPHDLITGGIITELGVFAPEELRTALTTTISSRDGTLDGPQM

SEQ ID NO: 816320 - protein, 179 aa, Homo sapiens
TRGSTHASRTRGSALQPGARLTAFELVYEQIPATLITDSMVAAAMAHRGVSAVVVGADRVVANGDTANKVGTYQLAIVAKHHGIPFYVAAPSSSCDLRLETGKEIIIEERPGQELTDVNGVRIAAPGIGVWNPAFDVTPHDLITGGIITELGVFAPEELRTALTTTISSRDGTLDGPQM

SEQ ID NO: 816321 - protein, 356 aa, Homo sapiens
MTLEAIRYSRGSLQILDQLLLPKQSRYEAVGSVHQAWEAIRAMKVRGAPAIALVGCLSLAVELQAGAGGPGLAALVAFVRDKLSFLVTARPTAVNMARAARDLADVAAREAEREGATEEAVRERVICCTEDMLEKDLRDNRSIGDLGARHLLERVAPSGGKVTVLTHCNTGALATAGYGTALDVKRSYASIGKSIPGRGNCHCEGPWAGLCSGARLTAFELVYEQIPATLITDSMVAAAMAHRGVSAVVVGADRVVANGDTANKVGTYQLAIVAKHHGIPFYVAAPSSSCDLRLETGKEIIIEERPGQELTDVNGVRIAAPGIGVWNPAFDVTPHDLITGGIITELGVFAPEEPPE

SEQ ID NO: 816322 - protein, 179 aa, Homo sapiens; identical to SEQ ID NO: 816320

SEQ ID NO: 816323 - protein, 369 aa, Homo sapiens; identical to SEQ ID NO: 816309

SEQ ID NO: 816324 - protein, 369 aa, Homo sapiens; identical to SEQ ID NO: 816309

SEQ ID NO: 816325 - protein, 369 aa, Homo sapiens; identical to SEQ ID NO: 816309

SEQ ID NO: 816326 - protein, 145 aa, Homo sapiens
NAQSRCCILSIDMLQYAMGTENGLQDNDIKLRVSEWEVIQESGTKLKPMYGPGYTGLKNLGNSCYLSSVMQAIFSIPEFQRAYVGNLPRIFDYSPLDPTQDFNTQMTKLGHGLLSGQYSKPPVKSELIEQVMKEEHKPQQNAILR

SEQ ID NO: 816327 - protein, 894 aa, Homo sapiens
AEFRGIPRRRRRQTPRSGSGSARSAPVRAEAMQRRGALFGMPGGSGGRKMAAGDIGELLVPHMPTIRVPRSGDRVYKNECAFSYDSPNSEGGLYVCMNTFLAFGREHVERHFRKTGQSVYMHLKRHVREKVRGASGGALPKRRNSKIFLDLDTDDDLNSDDYEYEDEAKLVIFPDHYEIALPNIEELPALVTIACDAVLSSKSPYRKQDPDTWENELPVSKYANNLTQLDNGVRIPPSGWKCARCDLRENLWLNLTDGSVLCGKWFFDSSGGNGHALEHYRDMGYPLAVKLGTITPDGADVYSFQEEEPVLDPHLAKHLAHFGIDMLHMHGTENGLQDNDIKLRVSEWEVIQESGTKLKPMYGPGYTGLKNLGNSCYLSSVMQAIFSIPEFQRAYVGNLPRIFDYSPLDPTQDFNTQMTKLGHGLLSGQYSKPPVKSELIEQVMKEEHKPQQNGISPRMFKAFVSKSHPEFSSNRQQDAQEFFLHLVNLVERNRIGSENPSDVFRFLVEERIQCCQTRKVRYTERVDYLMQLPVAMEAATNKDELIAYELTRREAEANRRPLPELVRAKIPFSACLQAFSEPENVDDFWSSALQAKSAGVKTSRFASFPEYLVVQIKKFTFGLDWVPKKFDVSIDMPDLLDINHLRARGLQPGEEELPDISPPIVIPDDSKDRLMNQLIDPSDIDESSVMQLAEMGFPLEACRKAVYFTGNMGAEVAFNWIIVHMEEPDFAEPLTMPGYGGAASAGASVFGASGLDNQPPEEIVAIITSMGFQRNQAIQALRATNNNLERALDWIFSHPEFEEDSDFVIEMENNANANIISEAKPEGPRVKDGSGTYELFAFISHMGTSTMSGHYICHIKKEGRWVIYNDHKVCASERPPKDLGYMYFYRRIPS

SEQ ID NO: 816328 - protein, 894 aa, Homo sapiens; identical to SEQ ID NO: 816327

SEQ ID NO: 816329 - protein, 1020 aa, Homo sapiens
ASSELPLCKPTIRDRKHLRGVFPGPSRAAFGRQPARAPAPTPQGFALRPPPPRPAHAQGPSPAPPPRHAAAGAPQPRLTLQLGRRLAIGLKIASPVRPKPAVPAPAPQPALPARPGSAGCRCPRSPPVSPLRWRRRRRQTPRSGSGSARSAPVRAEAMQRRGALFGMPGGSGGRKMAAGDIGELLVPHMPTIRVPRSGDRVYKNECAFSYDSPNSEGGLYVCMNTFLAFGREHVERHFRKTGQSVYMHLKRHVREKVRGASGGALPKRRNSKIFLDLDTDDDLNSDDYEYEDEAKLVIFPDHYEIALPNIEELPALVTIACDAVLSSKSPYRKQDPDTWENELPVSKYANNLTQLDNGVRIPPSGWKCARCDLRENLWLNLTDGSVLCGKWFFDSSGGNGHALEHYRDMGYPLAVKLGTITPDGADVYSFQEEEPVLDPHLAKHLAHFGIDMLHMHGTENGLQDNDIKLRVSEWEVIQESGTKLKPMYGPGYTGLKNLGNSCYLSSVMQAIFSIPEFQRAYVGNLPRIFDYSPLDPTQDFNTQMTKLGHGLLSGQYSKPPVKSELIEQVMKEEHKPQQNGISPRMFKAFVSKSHPEFSSNRQQDAQEFFLHLVNLVERNRIGSENPSDVFRFLVEERIQCCQTRKVRYTERVDYLMQLPVAMEAATNKDELIAYELTRREAEANRRPLPELVRAKIPFSACLQAFSEPENVDDFWSSALQAKSAGVKTSRFASFPEYLVVQIKKFTFGLDWVPKKFDVSIDMPDLLDINHLRARGLQPGEEELPDISPPIVIPDDSKDRLMNQLIDPSDIDESSVMQLAEMGFPLEACRKAVYFTGNMGAEVAFNWIIVHMEEPDFAEPLTMPGYGGAASAGASVFGASGLDNQPPEEIVAIITSMGFQRNQAIQALRATNNNLERALDWIFSHPEFEEDSDFVIEMENNANANIISEAKPEGPRVKDGSGTYELFAFISHMGTSTMSGHYICHIKKEGRWVIYNDHKVCASERPPKDLGYMYFYRRIPS

SEQ ID NO: 816330 - protein, 256 aa, Homo sapiens
ASSELPLCKPTIRDRKHLRGVFPGPSRAAFGRQPARAPAPTPQGFALRPPPPRPAHAQGPSPAPPPRHAAAGAPQPRLTLQLGRRLAIGLKIASPVRPKPAVPAPAPQPALPARPGSAGCRCPRSPPVSPLRWRRRRRQTPRSGSGSARSAPVRAEAMQRRGALFGMPGGSGGRKMAAGDIGELLVPHMPTIRVPRSGDRVYKNECAFSYDSPNSEGGLYVCMNTFLAFGREHVERHFRKTGQSVYMHLKRHVREI

SEQ ID NO: 816331 - protein, 43 aa, Homo sapiens
LTVLQVDVPHVKCKDQEPQPLGESKEHPRWEENCEEEAGGGPA

SEQ ID NO: 816332 - protein, 461 aa, Homo sapiens
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 816333 - protein, 461 aa, Homo sapiens; identical to SEQ ID NO: 816332

SEQ ID NO: 816334 - protein, 555 aa, Homo sapiens
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQVGPRRASAQSQLRPAAHVVRSGWVLPATLPSPPQSLSSGPTLLDWEPGLVQAQRRAPRWLPRLVGEGPSFLLEVGLPKPGRAGAQPAPTCLLPQDQLRFPRMLMKLVSLRTLSSVHSEQVFALRLQDKKLPPLLSEIWDVHE

SEQ ID NO: 816335 - protein, 461 aa, Homo sapiens; identical to SEQ ID NO: 816332

SEQ ID NO: 816336 - protein, 461 aa, Homo sapiens; identical to SEQ ID NO: 816332

SEQ ID NO: 816337 - protein, 264 aa, Homo sapiens
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQQESQSQSQSPVGPQGSSSSASGPGASPGGSEAGSQGSGEGEGVQLTAAQELMIQQLVAAQLQCNKRSFSDQPKVTLGRACRPIGSHPLG

SEQ ID NO: 816338 - protein, 285 aa, Homo sapiens
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQQESQSQSQSPVGPQGSSSSASGPGASPGGSEAGSQGSGEGEGVQLTAAQELPEGVKGLQVPTTDPSRLPSLPSLHLKPSTQCTLNRGRGGPMALPPSPGDQGPSSSSAFI

SEQ ID NO: 816339 - protein, 461 aa, Homo sapiens; identical to SEQ ID NO: 816332

SEQ ID NO: 816340 - protein, 461 aa, Homo sapiens; identical to SEQ ID NO: 816332

SEQ ID NO: 816341 - protein, 461 aa, Homo sapiens; identical to SEQ ID NO: 816332

SEQ ID NO: 816342 - protein, 488 aa, Homo sapiens
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCECSGRGRCRPGPPPSPGVLLRPAPPTGVLSEEQIRKKKIRKQQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 816343 - protein, 461 aa, Homo sapiens; identical to SEQ ID NO: 816332

SEQ ID NO: 816344 - protein, 235 aa, Homo sapiens
MIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 816345 - protein, 364 aa, Homo sapiens
MSSPTTSSLDTPLPGNGPPQPGAPSSSPTVKEEGPEPWPGGPDPDVPGTDEASSACSTDWGVLSEEQIRKKKIRKQQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 816346 - protein, 215 aa, Homo sapiens
PQLRLGARLGVNRPRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 816347 - protein, 150 aa, Homo sapiens
MLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 816348 - protein, 161 aa, Homo sapiens
DRNDKNAVITAVFPAPETVGSARVQDVGHGFGLRESRAASRPAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 816349 - protein, 264 aa, Homo sapiens; identical to SEQ ID NO: 816337

SEQ ID NO: 816350 - protein, 633 aa, Homo sapiens
MANQVNGNAVQLKEEEEPMDTSSVTHTEHYKTLIEAGLPQKVAERLDEIFQTGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 816351 - protein, 623 aa, Homo sapiens
CCRDRVSVHQGGEGVARAPFLVVFKAPRADSHGPGCRPPLCPGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 816352 - protein, 623 aa, Homo sapiens; identical to SEQ ID NO: 816351

SEQ ID NO: 816353 - protein, 633 aa, Homo sapiens; identical to SEQ ID NO: 816350

SEQ ID NO: 816354 - protein, 612 aa, Homo sapiens
SDRLAEFSLTIVFKAPRADSHGPGCRPPLCPGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 816355 - protein, 633 aa, Homo sapiens; identical to SEQ ID NO: 816350

SEQ ID NO: 816356 - protein, 623 aa, Homo sapiens; identical to SEQ ID NO: 816351

SEQ ID NO: 816357 - protein, 547 aa, Homo sapiens
CCRDRVSVHQGGEGVARAPFLVVFKAPRADSHGPGCRPPLCPGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGSRGNRGGNVGGKRKADGYNQPDSKRRQTNNQQNWGSQPIAQQPLQQGGDYSGNYGYNNDNQEFYQDTYGQQWK

SEQ ID NO: 816358 - protein, 623 aa, Homo sapiens; identical to SEQ ID NO: 816351

SEQ ID NO: 816359 - protein, 595 aa, Homo sapiens
MANQVNGNAVQLKEEEEPMDTSSVTHTEHYKTLIEAGLPQKVAERLDEIFQTGLVAYVDLDERAIDALREFNEEGALSVLQQFKESDLSHVQNKSAFLCGVMKTYRQREKQGSKVQESTKGPDEAKIKVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 816360 - protein, 532 aa, Homo sapiens
MKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 816361 - protein, 585 aa, Homo sapiens
CCRDRVSVHQGGEGVARAPFLVVFKAPRADSHGPGCRPPLCPGLVAYVDLDERAIDALREFNEEGALSVLQQFKESDLSHVQNKSAFLCGVMKTYRQREKQGSKVQESTKGPDEAKIKVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 816362 - protein, 574 aa, Homo sapiens
MANQVNGNAVQLKEEEEPMDTSSVTHTEHYKTLIEAGLPQKVAERLDEIFQTGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTECDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 816363 - protein, 564 aa, Homo sapiens
CCRDRVSVHQGGEGVARAPFLVVFKAPRADSHGPGCRPPLCPGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTECDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 816364 - protein, 507 aa, Homo sapiens
KDIARGAWVCNRPRAVKEIDLSHVQNKSAFLCGVMKTYRQREKQGSKVQESTKGPDEAKIKALLERTGYTLDVTTGQRKYGGPPPDSVYSGVQPGIGTECDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 816365 - protein, 526 aa, Homo sapiens
CCRDRVSVHQGGEGVARAPFLVVFKAPRADSHGPGCRPPLCPGLVAYVDLDERAIDALREFNEEGALSVLQQFKESDLSHVQNKSAFLCGVMKTYRQREKQGSKVQESTKGPDEAKIKCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 816366 - protein, 490 aa, Homo sapiens
CCRDRVSVHQGGEGVARAPFLVVFKAPRADSHGPGCRPPLCPGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGRGRWITRSGDRDHPG

SEQ ID NO: 816367 - protein, 447 aa, Homo sapiens
CCRDRVSVHQGGEGVARAPFLVVFKAPRADSHGPGCRPPLCPGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRLL

SEQ ID NO: 816368 - protein, 247 aa, Homo sapiens
MSILMKEQLMLSGNLMKKELCLYYSSSRKVTYHMFRTKVHFYVEYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 816369 - protein, 270 aa, Homo sapiens
MANQVNGNAVQLKEEEEPMDTSSVTHTEHYKTLIEAGLPQKVAERLDEIFQTGLVAYVDLDERAIDALREFNEEGALSVLQQFKESDLSHVQGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 816370 - protein, 418 aa, Homo sapiens
CCRDRVSVHQGGEGVARAPFLVVFKAPRADSHGPGCRPPLCPGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDDMMANEFGKGTQFELVLGQHQTRKEERSCKRLQSMV

SEQ ID NO: 816371 - protein, 337 aa, Homo sapiens
CCRDRVSVHQGGEGVARAPFLVVFKAPRADSHGPGCRPPLCPGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVNTVAWNG

SEQ ID NO: 816372 - protein, 284 aa, Homo sapiens
CCRDRVSVHQGGEGVARAPFLVVFKAPRADSHGPGCRPPLCPGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTGKTKMYLEITFAKYVVLLTSAQKN

SEQ ID NO: 816373 - protein, 233 aa, Homo sapiens
MANQVNGNAVQLKEEEEPMDTSSVTHTEHYKTLIEAGLPQKVAERLDEIFQTGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLVCDNYPLS

SEQ ID NO: 816374 - protein, 742 aa, Homo sapiens
RKRSREPWSFRACPVLLRKTYRGGSLRCVLGKLLGQLLCFQSERCVRFPEGLLRHRGCGLLSSRLSAGKPPLRTSFFGSWGVLPPLADAASMSGVRAVRISIESACEKQVHEVGLDGTETYLPPLSMSQNLARLAQRIDFSQGSGSEEEEAAGTEGDAQDWPGAGSSADQDDEEGVVKFQPSLWPWDSVRNNLRSALTEMCVLYDVLSIVRDKKFMTLDPVSQDALPPKQNPQTLQLISKKKSLAGAAQILLKGAERLTKSVTENQENKLQRDFNSELLRLRQHWKLRKVGDKILGDLSYRSAGSLFPHHGTFEVIKNTDLDLDKKIPEDYCPLDVQIPSDLEGSAYIKVSIQKQAPDIGDLGTVNLFKRPLPKSKPGSPHWQTKLEAAQNVLLCKEIFAQLSREAVQIKSQVPHIVVKNQIISQPFPSLQLSISLCHSSNDKKSQKFATEKQCPEDHLYVLEHNLHLLIREFHKQTLSSIMMPHPASAPFGHKRMRLSGPQAFDKNEINSLQSSEGLLEKIIKQAKHIFLRSRAAATIDSLASRIEDPQIQAHWSNINDVYESSVKVLITSQGYEQICKSIQLQLNIGVEQIRVVHRDGRVITLSYQEQELQDFLLSQMSQHQVHAVQQLAKVMGWQVLSFSNHVGLGPIESIGNASAITVASPSGDYAISVRNGPESGSKIMVQFPRNQCKDLPKSDVLQDNKWSHLRGPFKEVQWNKMEGRNFVYKMELLMSALSPCLL

SEQ ID NO: 816375 - protein, 236 aa, Homo sapiens
RKRSREPWSFRACPVLLRKTYRGGSLRCVLGKLLGQLLCFQSERCVRFPEGLLRHRGCGLLSSRLSAGKPPLRTSFFGSWGVLPPLADAASMSGVRAVRISIESACEKQVHEVGLDGTETYLPPLSMSQNLARLAQRIDFSQGSGSEEEEAAGTEGDAQDWPGAGSSADQDDEEGVVKFQPSLWPWDSVRNNLRSALTEMCVLYDVLSIVRDKKFMTLDPVSQDALPPKQVFVDFN

SEQ ID NO: 816376 - protein, 742 aa, Homo sapiens; identical to SEQ ID NO: 816374

SEQ ID NO: 816377 - protein, 742 aa, Homo sapiens; identical to SEQ ID NO: 816374

SEQ ID NO: 816378 - protein, 742 aa, Homo sapiens; identical to SEQ ID NO: 816374

SEQ ID NO: 816379 - protein, 429 aa, Homo sapiens
QARVQWRSLGSPQRLPPRFKRFSCLSLPSSWDYRHAPPFLANFVFLVEMGFLHVGQAGLEHPTSGSPHWQTKLEAAQNVLLCKEIFAQLSREAVQIKSQVPHIVVKNQIISQPFPSLQLSISLCHSSNDKKSQKFATEKQCPEDHLYVLEHNLHLLIREFHKQTLSSIMMPHPASAPFGHKRMRLSGPQAFDKNEINSLQSSEGLLEKIIKQAKHIFLRSRAAATIDSLASRIEDPQIQAHWSNINDVYESSVKVLITSQGYEQICKSIQLQLNIGVEQIRVVHRDGRVITLSYQEQELQDFLLSQMSQHQVHAVQQLAKVMGWQVLSFSNHVGLGPIESIGNASAITVASPSGDYAISVRNGPESGSKIMVQFPRNQCKDLPKSDVLQDNKWSHLRGPFKEVQWNKMEGRNFVYKMELLMSALSPCLL

SEQ ID NO: 816380 - protein, 261 aa, Homo sapiens [sequence omitted]

SEQ ID NO: 816381 - protein, 123 aa, Homo sapiens
MSQHQVHAVQQLAKVMGWQVLSFSNHVGLGPIESIGNASAITVASPSGDYAISVRNGPESGSKIMVQFPRNQCKDLPKSDVLQDNKWSHLRGPFKEVQWNKMEGRNFVYKMELLMSALSPCLL

SEQ ID NO: 816382 - protein, 264 aa, Homo sapiens
MHNPDGSASPTADPGSELQTLGQAARRPPPPRAGHDAPRRTRPSARKPLSCFSRRPMPTREPPKTRGSRGHLHTHPPGPGPPLQGLAPRGLKTSAPRPPCQPQPGPHKAKTKKIVFEDELLSQALLGAKKPIGAIPKGHKPRPHPVPDYELKYPPVSSERERSRYVAVFQDQYGEFLELQHEVGCAQAKLRQLEALLSSLPPPQSQKEAQVAARVWREFEMKRMDPGFLDKQARCHYLKGKLRHLKTQIQKFDDQGDSEGSVYF

SEQ ID NO: 816383 - protein, 109 aa, Homo sapiens
ALLSDPASRVHPAVNAQPGRKCLSDSRSRLGAPDAGTGRPQTTPAARGTRRPPQDPPISPETPELLLPEADAHPGAPKDSRLPGAPAYSPAWAWAPGEPDREGVPRPGL

SEQ ID NO: 816384 - protein, 130 aa, Homo sapiens
GRRCGPIACVYANSGRSGELCSRGVRVGRSSAELPARPFSVRVVRRVLSACPPTAARRPPPPRAGHDAPRRTRPSARKPLSCFSRRPMPTREPPKTRGSRGHLHTHPPGPGPPVSLTGRGSPGRASRQKI

SEQ ID NO: 816385 - protein, 208 aa, Homo sapiens
MPTREPPKTRGSRGHLHTHPPGPGPPLQGLAPRGLKTSAPRPPCQPQPGPHKAKTKKIVFEDELLSQALLGAKKPIGAIPKGHKPRPHPVPDYELKYPPVSSERERSRYVAVFQDQYGEFLELQHEVGCAQAKLRQLEALLSSLPPPQSQKEAQVAARVWREFEMKRMDPGFLDKQARCHYLKGKLRHLKTQIQKFDDQGDSEGSVYF

SEQ ID NO: 816386 - protein, 284 aa, Homo sapiens
MHNPDGSASPTADPGSELQTLGQAARRPPPPRAGHDAPRRTRPSARKPLSCFSRRPMPTREPPKTRGSRGHLHTHPPGPGPPLQGLAPRGLKTSAPRPPCQPQPGPHKAKTKKIVFEDELLSQALLGAKKPIGAIPKGHKPRPHPVPDYELKYPPVSSERERSRYVAVFQDQYGEFLELQHEVGCAQAKLRQLEALLSSLPPPQSQKEAQVAARVWREFEMKRMAGVQWYDLSSLQPQRPGFKRFSCLSWDHRRPPPCLANFCICSRDGVSPCWPGWSRTPDLK

SEQ ID NO: 816387 - protein, 109 aa, Homo sapiens; identical to SEQ ID NO: 816383

SEQ ID NO: 816388 - protein, 109 aa, Homo sapiens; identical to SEQ ID NO: 816383

SEQ ID NO: 816389 - protein, 245 aa, Homo sapiens
MHNPDGSASPTADPGSELQTLGQAARRPPPPRAGHDAPRRTRPSARKPLSCFSRRPMPTREPPKTRGSRGHLHTHPPGPGPPLQGLAPRGLKTSAPRPPCQPQPGPHKAKTKKIVFEDELLSQALLGAKKPIGAIPKGHKPRPHPVPDYELKYPPVSSERERSRYVAVFQDQYGEFLELQHEVGCAQAKLRQLEALLSSLPPPQSQKEAQVAARVWREFEMKRMLPLPGVAFSWIANASSVWTQL

SEQ ID NO: 816390 - protein, 130 aa, Homo sapiens; identical to SEQ ID NO: 816384

SEQ ID NO: 816391 - protein, 130 aa, Homo sapiens
ALLSDPASRVHPAVNAQPGRKCLSDSRSRLGAPDAGTGRPQTTPAARGTRRPPQDPPISPETPELLLPEADAHPGAPKDSRLPGAPAYSPAWAWAPAAGTGAPRPQNQRPPPSVPAPAGTPQGKDQEDCV

SEQ ID NO: 816392 - protein, 130 aa, Homo sapiens; identical to SEQ ID NO: 816391

SEQ ID NO: 816393 - protein, 245 aa, Homo sapiens; identical to SEQ ID NO: 816389

SEQ ID NO: 816394 - protein, 130 aa, Homo sapiens; identical to SEQ ID NO: 816384

SEQ ID NO: 816395 - protein, 342 aa, Homo sapiens
MSEESDSLRTSPSVASLSENELPPPPEPPGYVCSLTEDLVTKAREELQEKPEWRLRDVQALRDMVRKEYPNLSTSLDDAFLLRFLRARKFDYDRALQLLVNYHSCRRSWPEVFNNLKPSALKDVLASGFLTVLPHTDPRGCHVVCIRPDRWIPSNYPITENIRAIYLTLEKLIQSEETQVNGIVILADYKGVSLSKASHFGPFIAKKVIGILQDGFPIRIKAVHVVNEPRIFKGIFAIIKPFLKEKIANRFFLHGSDLNSLHTNLPRSILPKEYGGTAGELDTATWNAVLLASEDDFVKEFCQPVPACDSILGQTLLPEGLTSDAQCDDSLRAVKSQLYSCY

SEQ ID NO: 816396 - protein, 308 aa, Homo sapiens
MSEESDSLRTSPSVASLSENELPPPPEPPGYVCSLTEDLVTKAREELQEKPEWRLRDVQALRDMVRKEYPNLSTSLDDAFLLRFLRARKFDYDRALQLLVNYHSCRRSWPEVFNNLKPSALKDVLASGFLTVLPHTDPRGCHVVCIRPDRWIPSNYPITENIRAIYLTLEKLIQSEETQDGFPIRIKAVHVVNEPRIFKGIFAIIKPFLKEKIANRFFLHGSDLNSLHTNLPRSILPKEYGGTAGELDTATWNAVLLASEDDFVKEFCQPVPACDSILGQTLLPEGLTSDAQCDDSLRAVKSQLYSCY

SEQ ID NO: 816397 - protein, 288 aa, Homo sapiens
MAATFFGEVVKAPCRAGTEDEEEEEEGRRETPEDREVRLQLARKREVRLLRRQTKTSLEVSLLEKYPCSKFIIAIGNNAVAFLSSFVMNSGVWEEVGCAKLWNEWCRTTDTTHLSSTEAFCVFYHLKSNPSVFLCQCSCYVAEDQQYQWLEKVFGSCPRKNMQITILTCRHVTDYKTSESTGSLPSPFLRALKTQNFKDSACCPLLEQPNIVHDLPAAVLSYCQVWKIPAILYLCYTDVMKLDLITVEAFKPILSTRSLKGLVKNIPQSTEILKKLMTTNEIQSNIYT

SEQ ID NO: 816398 - protein, 201 aa, Homo sapiens
MNSGVWEEVGCAKLWNEWCRTTDTTHLSSTEAFCVFYHLKSNPSVFLCQCSCYVAEDQQYQWLEKVFGSCPRKNMQITILTCRHVTDYKTSESTGSLPSPFLRALKTQNFKDSACCPLLEQPNIVHDLPAAVLSYCQVWKIPAILYLCYTDVMKLDLITVEAFKPILSTRSLKGLVKNIPQSTEILKKLMTTNEIQSNIYT

SEQ ID NO: 816399 - protein, 271 aa, Homo sapiens
MAATFFGEVVKAPCRAGTEDEEEEEEGRRETPEDREVRLQLARKREVRLLRRQTKTSLEVSLLEKYPCSKFIIAIGNNAVAFLSSFVMNSGVWEEVGCAKLWNEWCRTTDTTHLSSTEAFCVFYHLKSNPSVFLCQCSCYVAEDQQYQWLEKVFGSCPRKNMQITILTCRHVTDYKTQNFKDSACCPLLEQPNIVHDLPAAVLSYCQVWKIPAILYLCYTDVMKLDLITVEAFKPILSTRSLKGLVKNIPQSTEILKKLMTTNEIQSNIYT

SEQ ID NO: 816400 - protein, 144 aa, Homo sapiens
MAATFFGEVVKAPCRAGTEDEEEEEEGRRETPEDREVRLQLARKREVRLLRRQTKTSLEVSLLEKYPCSKFIIAIGNNAVAFLSSFVMNSGVWEEVGCAKLWNEWCRTTDTTHLSSTEAFCVFYHLKSNPSKHRISKTRRVVHC

SEQ ID NO: 816401 - protein, 133 aa, Homo sapiens
MAATFFGEVVKAPCRAGTEDEEEEEEGRRETPEDREVRLQLARKREVRLLRRQTKTSLEVSLLEKYPCSKFIIAIGNNAVAFLSSFVMNSGVWEEVGCAKLWNEWCRTTDTTHLSSTEAFCVFYHLKSNPSKP

SEQ ID NO: 816402 - protein, 103 aa, Homo sapiens
MPGPPESLDMGPLTFRDVAIEFSLEEWQCLDTAQQDLYRKVMLENYRNLVFLAGIAVSKPDLVTCLEQGKDPWNMKGHSTVVKPPVETGFHRFGQDGLYLLTS

SEQ ID NO: 816403 - protein, 113 aa, Homo sapiens
MPGPPESLDMGPLTFRDVAIEFSLEEWQCLDTAQQDLYRKVMLENYRNLVFLAGIAVSKPDLVTCLEQGKDPWNMKGHSTVVKPPVICSHFAEDFCPGPGIKDSFQKVILREY

SEQ ID NO: 816404 - protein, 1312 aa, Homo sapiens
RRSRTIRAAGDATKPGGRRLRAPSQQPGGQKPPVLGPRASDAGKCPHPGNLQRSAAAATLSGRQNGGGGGGGLVLRGSQVLTTPGTGRAGPRQPPRSSPRSAPPGILGVAGTDSGRLSVRPQARGRCPGALLSPPELIIYIVKNFNSPGDFLEGSFSLLLRRKLWIYQIKKSFVWATYIDVFMKRSEKPEGYRQMRPKTFPASNYTVSSRQMLQEIRESLRNLSKPSDAAKAEHNMSKMSTEDPRQVRNPPKFGTHHKALQEIRNSLLPFANETNSSRSTSEVNPQMLQDLQAAGFDEDMVIQALQKTNNRSIEAAIEFISKMSYQDPRREQMAAAAARPINASMKPGNVQQSVNRKQSWKGSKESLVPQRHGPPLGESVAYHSESPNSQTDVGRPLSGSGISAFVQAHPSNGQRVNPPPPPQVRSVTPPPPPRGQTPPPRGTTPPPPSWEPNSQTKRYSGNMEYVISRISPVPPGAWQEGYPPPPLNTSPMNPPNQGQRGISSVPVGRQPIIMQSSSKFNFPSGRPGMQNGTGQTDFMIHQNVVPAGTVNRQPPPPYPLTAANGQSPSALQTGGSAAPSSYTNGSIPQSMMVPNRNSHNMELYNISVPGLQTNWPQSSSAPAQSSPSSGHEIPTWQPNIPVRSNSFNNPLGNRASHSANSQPSATTVTAITPAPIQQPVKSMRVLKPELQTALAPTHPSWIPQPIQTVQPSPFPEGTASNVTVMPPVAEAPNYQGPPPPYPKHLLHQNPSVPPYESISKPSKEDQPSLPKEDESEKSYENVDSGDKEKKQITTSPITVRKNKKDEERRESRIQSYSPQAFKFFMEQHVENVLKSHQQRLHRKKQLENEMMRVGLSQDAQDQMRKMLCQKESNYIRLKRAKMDKSMFVKIKTLGIGAFGEVCLARKVDTKALYATKTLRKKDVLLRNQVAHVKAERDILAEADNEWVVRLYYSFQDKDNLYFVMDYIPGGDMMSLLIRMGIFPESLARFYIAELTCAVESVHKMGFIHRDIKPDNILIDRDGHIKLTDFGLCTGFRWTHDSKYYQSGDHPRQDSMDFSNEWGDPSSCRCGDRLKPLERRAARQHQRCLAHSLVGTPNYIAPEVLLRTGYTQLCDWWSVGVILFEMLVGQPPFLAQTPLETQMKVINWQTSLHIPPQAKLSPEASDLIIKLCRGPEDRLGKNGADEIKAHPFFKTIDFSSDLRQQSASYIPKITHPTDTSNFDPVDPDKLWSDDNEEENVNDTLNGWYKNGKHPEHAFYEFTFRRFFDDNGYPYNYPKPIEYEYINSQGSEQQSDEDDQNTGSEIKNRDLVYV

SEQ ID NO: 816405 - protein, 442 aa, Homo sapiens
RRSRTIRAAGDATKPGGRRLRAPSQQPGGQKPPVLGPRASDAGKCPHPGNLQRSAAAATLSGRQNGGGGGGGLVLRGSQVLTTPGTGRAGPRQPPRSSPRSAPPGILGVAGTDSGRLSVRPQARGRCPGALLSPPELIIYIVKNFNSPGDFLEGSFSLLLRRKLWIYQIKKSFVWATYIDVFMKRSEKPEGYRQMRPKTFPASNYTVSSRQMLQEIRESLRNLSKPSDAAKAEHNMSKMSTEDPRQVRNPPKFGTHHKALQEIRNSLLPFANETNSSRSTSEVNPQMLQDLQAAGFDEEDHLSVACSPISLTKPFLHLKMSFEILNPLGQDMVIQALQKTNNRSIEAAIEFISKMSYQDPRREQMAAAAARPINASMKPGNVQQSVNRKQSWKGSKESLVPQRHGPPLGESVAYHSESPNSQTDVGRPLSGSGISAFVQAHP

SEQ ID NO: 816406 - protein, 872 aa, Homo sapiens
RRSRTIRAAGDATKPGGRRLRAPSQQPGGQKPPVLGPRASDAGKCPHPGNLQRSAAAATLSGRQNGGGGGGGLVLRGSQVLTTPGTGRAGPRQPPRSSPRSAPPGILGVAGTDSGRLSVRPQARGRCPGALLSPPELIIYIVKNFNSPGDFLEGSFSLLLRRKLWIYQIKKSFVWATYIDVFMKRSEKPEGYRQMRPKTFPASNYTVSSRQMLQEIRESLRNLSKPSDAAKAEHNMSKMSTEDPRQVRNPPKFGTHHKALQEIRNSLLPFANETNSSRSTSEVNPQMLQDLQAAGFDEDMVIQALQKTNNRSIEAAIEFISKMSYQDPRREQMAAAAARPINASMKPGNVQQSVNRKQSWKGSKESLVPQRHGPPLGESVAYHSESPNSQTDVGRPLSGSGISAFVQAHPSNGQRVNPPPPPQVRSVTPPPPPRGQTPPPRGTTPPPPSWEPNSQTKRYSGNMEYVISRISPVPPGAWQEGYPPPPLNTSPMNPPNQGQRGISSVPVGRQPIIMQSSSKFNFPSGRPGMQNGTGQTDFMIHQNVVPAGTVNRQPPPPYPLTAANGQSPSALQTGGSAAPSSYTNGSIPQSMMVPNRNSHNMELYNISVPGLQTNWPQSSSAPAQSSPSSGHEIPTWQPNIPVRSNSFNNPLGNRASHSANSQPSATTVTAITPAPIQQPVKSMRVLKPELQTALAPTHPSWIPQPIQTVQPSPFPEGTASNVTVMPPVAEAPNYQGPPPPYPKHLLHQNPSVPPYESISKPSKEDQPSLPKEDESEKSYENVDSGDKEKKQITTSPITVRKNKKDEERRESRIQSYSPQAFKFFMEQHVENVLKSHQQRLHRKKQLENEMMRVKPFKMSIFILNHLFAWCLF

SEQ ID NO: 816407 - protein, 870 aa, Homo sapiens
RRSRTIRAAGDATKPGGRRLRAPSQQPGGQKPPVLGPRASDAGKCPHPGNLQRSAAAATLSGRQNGGGGGGGLVLRGSQVLTTPGTGRAGPRQPPRSSPRSAPPGILGVAGTDSGRLSVRPQARGRCPGALLSPPELIIYIVKNFNSPGDFLEGSFSLLLRRKLWIYQIKKSFVWATYIDVFMKRSEKPEGYRQMRPKTFPASNYTVSSRQMLQEIRESLRNLSKPSDAAKAEHNMSKMSTEDPRQVRNPPKFGTHHKALQEIRNSLLPFANETNSSRSTSEVNPQMLQDLQAAGFDEDMVIQALQKTNNRSIEAAIEFISKMSYQDPRREQMAAAAARPINASMKPGNVQQSVNRKQSWKGSKESLVPQRHGPPLGESVAYHSESPNSQTDVGRPLSGSGISAFVQAHPSNGQRVNPPPPPQVRSVTPPPPPRGQTPPPRGTTPPPPSWEPNSQTKRYSGNMEYVISRISPVPPGAWQEGYPPPPLNTSPMNPPNQGQRGISSVPVGRQPIIMQSSSKFNFPSGRPGMQNGTGQTDFMIHQNVVPAGTVNRQPPPPYPLTAANGQSPSALQTGGSAAPSSYTNGSIPQSMMVPNRNSHNMELYNISVPGLQTNWPQSSSAPAQSSPSSGHEIPTWQPNIPVRSNSFNNPLGNRASHSANSQPSATTVTAITPAPIQQPVKSMRVLKPELQTALAPTHPSWIPQPIQTVQPSPFPEGTASNVTVMPPVAEAPNYQGPPPPYPKHLLHQNPSVPPYESISKPSKEDQPSLPKEDESEKSYENVDSGDKEKKQITTSPITVRKNKKDEERRESRIQSYSPQAFKFFMEQHVENVLKSHQQRLHRKKQLENEMMRVGLSQMPGSMCRCLPFDL

SEQ ID NO: 816408 - protein, 450 aa, Homo sapiens [sequence omitted]

SEQ ID NO: 816409 - protein, 141 aa, Homo sapiens
ALETRPTVTPRAGGQASALLPYSRAHCSLSPGATRSPNTMVRYRVRSLSERSHEVYRQQLHGQEQGHHGQEEQGLSPEHVEVYERTHGQSHYRRRHCSRRRLHRIHRRQHRSCRRRKRRSCRHRRRHRRGCRTRKRTCRRH

SEQ ID NO: 816410 - protein, 141 aa, Homo sapiens; identical to SEQ ID NO: 816409

SEQ ID NO: 816411 - protein, 141 aa, Homo sapiens; identical to SEQ ID NO: 816409

SEQ ID NO: 816412 - protein, 148 aa, Homo sapiens
VSHINIGKRVSGRILGYKAGGQASALLPYSRAHCSLSPGATRSPNTMVRYRVRSLSERSHEVYRQQLHGQEQGHHGQEEQGLSPEHVEVYERTHGQSHYRRRHCSRRRLHRIHRRQHRSCRRRKRRSCRHRRRHRRGCRTRKRTCRRH

SEQ ID NO: 816413 - protein, 141 aa, Homo sapiens
VSHINIGKRVSGRILGYKAGGQASALCSLSPGATRSPNTMVRYRVRSLSERSHEVYRQQLHGQEQGHHGQEEQGLSPEHVEVYERTHGQSHYRRRHCSRRRLHRIHRRQHRSCRRRKRRSCRHRRRHRRGCRTRKRTCRRH

SEQ ID NO: 816414 - protein, 222 aa, Homo sapiens
MKFPAGLLLPASSPVGGSDDAGLLGRPVDRFSPGFWMQPQQAKVLHSCTGNTDTGVTKMLKQDVQELLRSAHVTRALPPPPPIFALVARPWAPPLPHQTGGGVLLGMEVGDARLLETPAERGGMAGRMLAARVWPPGSAARPRPGLADLVAQVPPRREVCGKFCSCFPARASGGVVTQRLGILAGTEEREGEAGRDWETEQQEKGRTLGSSWTRRVLLSATP

SEQ ID NO: 816415 - protein, 122 aa, Homo sapiens
LVETWSLPGVWPSPGLVPGNGVREAEPSLNPDPFPVDPSLSPSPAALPPAPGTELSYLNGTFRLLQKPLRWHDALLLCESHNASLAYVPDPYTQAFLTQAHPGATAWDNVNMDSKTWPFLCS

SEQ ID NO: 816416 - protein, 1479 aa, Homo sapiens
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPSEENCGVIRTESSGGWQNRDCSIALPYVCKKKPNATAEPTPPDRWANVKVECEPSWQPFQGHCYRLQAEKRSWQESKKACLRGGGDLVSIHSMAELEFITKQIKQEVEELWIGLNDLKLQMNFEWSDGSLVSFTHWHPFEPNNFRDSLEDCVTIWGPEGRWNDSPCNQSLPSICKKAGQLSQGAAEEDHGCRKGWTWHSPSCYWLGEDQVTYSEARRLCTDHGSQLVTITNRFEQAFVSSLIYNWEGEYFWTALQDLNSTGSFFWLSGDEVMYTHWNRDQPGYSRGGCVALATGSAMGLWEVKNCTSFRARYICRQSLGTPVTPELPGPDPTPSLTGSCPQGWASDTKLRYCYKVFSSERLQDKKSWVQAQGACQELGAQLLSLASYEEEHFVANMLNKIFGESEPEIHEQHWFWIGLNRRDPRGGQSWRWSDGVGFSYHNFDRSRHDDDDIRGCAVLDLASLQWVAMQCDTQLDWICKIPRGTDVREPDDSPQGRREWLRFQEAEYKFFEHHSTWAQAQRICTWFQAELTSVHSQAELDFLSHNLQKFSRAQEQHWWIGLHTSESDGRFRWTDGSIINFISWAPGKPRPVGKDKKCVYMTASREDWGDQRCLTALPYICKRSNVTKETQPPDLPTTALGGCPSDWIQFLNKCFQVQGQEPQSRVKWSEAQFSCEQQEAQLVTITNPLEQAFITASLPNVTFDLWIGLHASQRDFQWVEQEPLMYANWAPGEPSGPSPAPSGNKPTSCAVVLHSPSAHFTGRWDDRSCTEETHGFICQKGTDPSLSPSPAALPPAPGTELSYLNGTFRLLQKPLRWHDALLLCESHNASLAYVPDPYTQAFLTQAARGLRTPLWIGLAGEEGSRRYSWVSEEPLNYVGWQDGEPQQPGGCTYVDVDGAWRTTSCDTKLQGAVCGVSSGPPPPRRISYHGSCPQGLADSAWIPFREHCYSFHMELLLGHKEARQRCQRAGGAVLSILDEMENVFVWEHLQSYEGQSRGAWLGMNFNPKGGTLVWQDNTAVNYSNWGPPGLGPSMLSHNSCYWIQSNSGLWRPGACTNITMGVVCKLPRAEQSSFSPSALPENPAALVVVLMAVLLLLALLTAALILYRRRQSIERGAFEGARYSRSSSSPTEATEKNILVSDMEMNEQQE

SEQ ID NO: 816417 - protein, 1479 aa, Homo sapiens; identical to SEQ ID NO: 816416

SEQ ID NO: 816418 - protein, 704 aa, Homo sapiens
AWHGACLGPVCLQARLLPPGSAPALPRPPPGPGVQPLPGRRSHARAAPAGRREWLRFQEAEYKFFEHHSTWAQAQRICTWFQAELTSVHSQAELDFLSHNLQKFSRAQEQHWWIGLHTSESDGRFRWTDGSIINFISWAPGKPRPVGKDKKCVYMTASREDWGDQRCLTALPYICKRSNVTKETQPPDLPTTALGGCPSDWIQFLNKCFQVQGQEPQSRVKWSEAQFSCEQQEAQLVTITNPLEQAFITASLPNVTFDLWIGLHASQRDFQWVEQEPLMYANWAPGEPSGPSPAPSGNKPTSCAVVLHSPSAHFTGRWDDRSCTEETHGFICQKGTDPSLSPSPAALPPAPGTELSYLNGTFRLLQKPLRWHDALLLCESHNASLAYVPDPYTQAFLTQAARGLRTPLWIGLAGEEGSRRYSWVSEEPLNYVGWQDGEPQQPGGCTYVDVDGAWRTTSCDTKLQGAVCGVSSGPPPPRRISYHGSCPQGLADSAWIPFREHCYSFHMELLLGHKEARQRCQRAGGAVLSILDEMENVFVWEHLQSYEGQSRGAWLGMNFNPKGGTLVWQDNTAVNYSNWGPPGLGPSMLSHNSCYWIQSNSGLWRPGACTNITMGVVCKLPRAEQSSFSPSALPENPAALVVVLMAVLLLLALLTAALILYRRRQSIERGAFEGARYSRSSSSPTEATEKNILVSDMEMNEQQE

SEQ ID NO: 816419 - protein, 1479 aa, Homo sapiens; identical to SEQ ID NO: 816416

SEQ ID NO: 816420 - protein, 1323 aa, Homo sapiens
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPSEENCGVIRTESSGGWQNRDCSIALPYVCKKKPNATAEPTPPDRWANVKVECEPSWQPFQGHCYRLQAEKRSWQESKKACLRGGGDLVSIHSMAELEFITKQIKQEVEELWIGLNDLKLQMNFEWSDGSLVSFTHWHPFEPNNFRDSLEDCVTIWGPEGRWNDSPCNQSLPSICKKAGQLSQGAAEEDHGCRKGWTWHSPSCYWLGEDQVTYSEARRLCTDHGSQLVTITNRFEQAFVSSLIYNWEGEYFWTALQDLNSTGSFFWLSGDEVMYTHWNRDQPGYSRGGCVALATGSAMGLWEVKNCTSFRARYICRQSLGTPVTPELPGPDPTPSLTGSCPQGWASDTKLRYCYKVFSSERLQDKKSWVQAQGACQELGAQLLSLASYEEEHFVANMLNKIFGESEPEIHEQHWFWIGLNRRDPRGGQSWRWSDGVGFSYHNFDRSRHDDDDIRGCAVLDLASLQWVAMQCDTQLDWICKIPRGTDVREPDDSPQGRREWLRFQEAEYKFFEHHSTWAQAQRICTWFQAELTSVHSQAELDFLSHNLQKFSRAQEQHWWIGLHTSESDGRFRWTDGSIINFISWAPGKPRPVGKDKKCVYMTASREDWGDQRCLTALPYICKRSNVTKETQPPDLPTTALGGCPSDWIQFLNKCFQVQGQEPQSRVKWSEAQFSCEQQEAQLVTITNPLEQAFITASLPNVTFDLWIGLHASQRDFQWVEQEPLMYANWAPGEPSGPSPAPSGNKPTSCAVVLHSPSAHFTGRWDDRSCTEETHGFICQKGTDPSLSPSPAALPPAPGTELSYLNGTFRLLQKPLRWHDALLLCESHNASLAYVPDPYTQAFLTQAARGLRTPLWIGLAGEEGSRRYSWVSEEPLNYVGWQDGEPQQPGGCTYVDVDGAWRTTSCDTKLQGAVCGVSSGPPPPRRISYHGSCPQGLADSAWIPFREHCYSFHMELLLGHKEARQRCQRAGGAVLSILDEMENVFVWKSPLWGPK

SEQ ID NO: 816421 - protein, 907 aa, Homo sapiens
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPSEENCGVIRTESSGGWQNRDCSIALPYVCKKKPNATAEPTPPDRWANVKVECEPSWQPFQGHCYRLQAEKRSWQESKKACLRGGGDLVSIHSMAELEFITKQIKQEVEELWIGLNDLKLQMNFEWSDGSLVSFTHWHPFEPNNFRDSLEDCVTIWGPEGRWNDSPCNQSLPSICKKAGQLSQGAAEEDHGCRKGWTWHSPSCYWLGEDQVTYSEARRLCTDHGSQLVTITNRFEQAFVSSLIYNWEGEYFWTALQDLNSTGSFFWLSGDEVMYTHWNRDQPGYSRGGCVALATGSAMGLWEVKNCTSFRARYICRQSLGTPVTPELPGPDPTPSLTGSCPQGWASDTKLRYCYKVFSSERLQDKKSWVQAQGACQELGAQLLSLASYEEEHFVANMLNKIFGESEPEIHEQHWFWIGLNRRDPRGGQSWRWSDGVGFSYHNFDRSRHDDDDIRGCAVLDLASLQWVAMQCDTQLDWICKIPRGTDVREPDDSPQGRREWLRFQEAEYKFFEHHSTWAQAQRICTWFQAELTSVHSQAELDFLSHNLQKFSRAQEQHWWIGLHTSESDGRFRRNPGRQ

SEQ ID NO: 816422 - protein, 285 aa, Homo sapiens
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKEEQESGRAQSSPSSGSRRSSTRALEWPSTLPRGHSPSQDKVCGPSWCDSVGQCEHGLEDMALSL

SEQ ID NO: 816423 - protein, 901 aa, Homo sapiens
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPSEENCGVIRTESSGGWQNRDCSIALPYVCKKKPNATAEPTPPDRWANVKVECEPSWQPFQGHCYRLQAEKRSWQESKKACLRGGGDLVSIHSMAELEFITKQIKQEVEELWIGLNDLKLQMNFEWSDGSLVSFTHWHPFEPNNFRDSLEDCVTIWGPEGRWNDSPCNQSLPSICKKAGQLSQGAAEEDHGCRKGWTWHSPSCYWLGEDQVTYSEARRLCTDHGSQLVTITNRFEQAFVSSLIYNWEGEYFWTALQDLNSTGSFFWLSGDEVMYTHWNRDQPGYSRGGCVALATGSAMGLWEVKNCTSFRARYICRQSLGTPVTPELPGPDPTPSLTGSCPQGWASDTKLRYCYKVFSSERLQDKKSWVQAQGACQELGAQLLSLASYEEEHFVANMLNKIFGESEPEIHEQHWFWIGLNRRDPRGGQSWRWSDGVGFSYHNFDRSRHDDDDIRGCAVLDLASLQWVAMQCDTQLDWICKIPRGTDVREPDDSPQGRREWLRFQEAEYKFFEHHSTCTCAAPVPTWSGAQRTCTRPPGSAILLDLDLRAFVLLTHLRISWVSSGSSLAVCRT

SEQ ID NO: 816424 - protein, 211 aa, Homo sapiens
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTILVRQRGTM

SEQ ID NO: 816425 - protein, 553 aa, Homo sapiens
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPSEENCGVIRTESSGGWQNRDCSIALPYVCKKKPNATAEPTPPDRWANVKVECEPSWQPFQGHCYRLQAEKRSWQESKKACLRGGGDLVSIHSMAELEFITKQIKQEVEELWIGLNDLKLQMNFEWSDGSLVSFTHWHPFEPNNFRDSLEDCVTIWGPEGRWNDSPCNQSLPSICKKAGQLSQGAAEEDHGCRKSPSQDKVCGPSWCDSVGQCEHGLEDMALSL

SEQ ID NO: 816426 - protein, 129 aa, Homo sapiens
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRILVRQRGTM

SEQ ID NO: 816427 - protein, 240 aa, Homo sapiens
KEAGWRGGCWRPGSGHLGQLHAPAPGWPDLVAQVPPRREVCGKFCSCFPARASGGVVTQRLGILAGTEEREGEAGRDWETEQQEKGRTLGSSWTRRVLLSATPFSPSRRSSPRPAPPPLPLPRCPLPFPSTPRTLLPGSALLPPPGLPPPSSSPGGITSSRPGGGREPLAGGHHSPASGLPQRVAPVRPRSPRPLSAALGDGARPAGPRALASSPAALRPAPRVPAPRPSRRPWGRRPPG

SEQ ID NO: 816428 - protein, 347 aa, Homo sapiens
METNGAKIVSTRAWKKNEKLELLVGCIAELREADEGLLRAGENDFSIMYSTRKRSAQLWLGPAAFINHDCKPNCKFVPADGNAACVKVLRDIEPGDEVTCFYGEGFFGEKNEHCECHTCERKGEGAFRTRPREPALPPRPLDKYQLRETKRRLQQGLDSGSRQGLLGPRACVHPSPLRRDPFCAACQPLRLPACSARPDTSPLWLQWLPQPQPRVRPRKRRRPRPRRAPVLSTHHAARVSLHRWGGCGPHCRLRGEALVALGQPPHARWAPQQDWHWARRYGLPYVVRVDLRRLAPAPPATPAPAGTPGPILIPKQALAFAPFSPPKRLRLVVSHGSIDLDVGGEEL

SEQ ID NO: 816429 - protein, 347 aa, Homo sapiens; identical to SEQ ID NO: 816428

SEQ ID NO: 816430 - protein, 462 aa, Homo sapiens
MGPDRVTARELCENDDLATSLVLDPYLGFRTHKMNVSPVPPLRRQQHLRSALETFLRQRDLEAAYRALTLGGWTARYFQSRGPRQEAALKTHVYRYLRAFLPESGFTILPCTRYSMETNGAKIVSTRAWKKNEKLELLVGCIAELREADEGLLRAGENDFSIMYSTRKRSAQLWLGPAAFINHDCKPNCKFVPADGNAACVKVLRDIEPGDEVTCFYGEGFFGEKNEHCECHTCERKGEGAFRTRPREPALPPRPLDKYQLRETKRRLQQGLDSGSRQGLLGPRACVHPSPLRRDPFCAACQPLRLPACSARPDTSPLWLQWLPQPQPRVRPRKRRRPRPRRAPVLSTHHAARVSLHRWGGCGPHCRLRGEALVALGQPPHARWAPQQDWHWARRYGLPYVVRVDLRRLAPAPPATPAPAGTPGPILIPKQALAFAPFSPPKRLRLVVSHGSIDLDVGGEEL

SEQ ID NO: 816431 - protein, 447 aa, Homo sapiens
MGPDRVTARELCENDDLATSLVLDPYLGFRTHKMNVSPVPPLRRQQHLRSALETFLRQRDLEAAYRALTLGGWTARYFQSRGPRQEAASRPTSIATSVPSCRKVALPSCPARATPWRPTGPRSCPLVLELREADEGLLRAGENDFSIMYSTRKRSAQLWLGPAAFINHDCKPNCKFVPADGNAACVKVLRDIEPGDEVTCFYGEGFFGEKNEHCECHTCERKGEGAFRTRPREPALPPRPLDKYQLRETKRRLQQGLDSGSRQGLLGPRACVHPSPLRRDPFCAACQPLRLPACSARPDTSPLWLQWLPQPQPRVRPRKRRRPRPRRAPVLSTHHAARVSLHRWGGCGPHCRLRGEALVALGQPPHARWAPQQDWHWARRYGLPYVVRVDLRRLAPAPPATPAPAGTPGPILIPKQALAFAPFSPPKRLRLVVSHGSIDLDVGGEEL

SEQ ID NO: 816432 - protein, 456 aa, Homo sapiens
MGPDRVTARELCENDDLATSLVLDPYLGFRTHKMNVRSIATSVPSCRKVALPSCPARATPWRPTGPRSCPLVLAVPLVNEELTYSLDAAVWACICMRLREGRLRGLLDAARVSELDVSGILVAIVEALGYAGRSLMPWWPCGLTPAFSTLERDCSLQRAPELRETRCVAVLPCANVMPSAVKGDSGGHLQVLVALRLHHAFLPRDGASSAMKELSDCELRTTCDDGHRDWKGEGAFRTRPREPALPPRPLDKYQLRETKRRLQQGLDSGSRQGLLGPRACVHPSPLRRDPFCAACQPLRLPACSARPDTSPLWLQWLPQPQPRVRPRKRRRPRPRRAPVLSTHHAARVSLHRWGGCGPHCRLRGEALVALGQPPHARWAPQQDWHWARRYGLPYVVRVDLRRLAPAPPATPAPAGTPGPILIPKQALAFAPFSPPKRLRLVVSHGSIDLDVGGEEL

SEQ ID NO: 816433 - protein, 319 aa, Homo sapiens
RNATFRGSAVAPFQERTLRARVPGQVWGVGEPSPVPWARALSGLGPQFVPADGNAACVKVLRDIEPGDEVTCFYGEGFFGEKNEHCECHTCERKGEGAFRTRPREPALPPRPLDKYQLRETKRRLQQGLDSGSRQGLLGPRACVHPSPLRRDPFCAACQPLRLPACSARPDTSPLWLQWLPQPQPRVRPRKRRRPRPRRAPVLSTHHAARVSLHRWGGCGPHCRLRGEALVALGQPPHARWAPQQDWHWARRYGLPYVVRVDLRRLAPAPPATPAPAGTPGPILIPKQALAFAPFSPPKRLRLVVSHGSIDLDVGGEEL

SEQ ID NO: 816434 - protein, 230 aa, Homo sapiens
MGPDRVTARELCENDDLATSLVLDPYLGFRTHKMNVSPVPPLRRQQHLRSALETFLRQRDLEAAYRALTLGGWTARYFQSRGPRQEAALKTHVYRYLRAFLPESGFTILPCTRYSMETNGAKIVSTRAWKKNEKLELLVGCIAELREADEGLLRAGENDFSIMYSTRKRSAQLWLGPAAFINHDCKPNCKVRPWDSGGEGTQEERVPVAWGKGFWSVKSQTPAGRGGSCL

SEQ ID NO: 816435 - protein, 72 aa, Homo sapiens
MELGSRRRSVGCRCRGLCLAVRREQVTFEDVVVDFSQEEWGQLKPAQRTLYRDVMLDTFRLLVSVAPLCLPP

SEQ ID NO: 816436 - protein, 692 aa, Homo sapiens
MELGSRRRSVGCRCRGLCLAVRRSRASRSCQKPGMTPGVRVSTDPEQVTFEDVVVDFSQEEWGQLKPAQRTLYRDVMLDTFRLLVSVGHWLPKPNVISLLEQEAELWAVESRLPQGVYPDLETRPKVKLSVLKQGISEEISNSVILVERFLWDGLWYCRGEDTEGHWEWSCESLESLAVPVAFTPVKTPVLEQWQRNGFGENISLNPDLPHQPMTPERQSPHTWGTRGKREKPDLNVLQKTCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFSHSSSLTKHQRIHTGEKPYECHECGKAFTQITPLIQHQRTHTGEKPYECGECGKAFSQSTLLTEHRRIHTGEKPYGCNECGKTFSHSSSLSQHERTHTGEKPYECSQCGKAFRQSTHLTQHQRIHTGEKPYECNDCGKAFSHSSSLTKHQRIHTGEKPYECNQCGRAFSQLAPLIQHQRIHTGEKPYECNQCGRAFSQSSLLIEHQRIHTKEKPYGCNECGKSFSHSSSLSQHERTHTGEKPYECHDCGKSFRQSTHLTQHRRIHTGEKPYACRDCGKAFTHSSSLTKHQRTHTG

SEQ ID NO: 816437 - protein, 153 aa, Homo sapiens
LIIEVSLLHRVICKTFRSGLLPSFSIRGSTQERNPMNVTSVAEPSARAPFSSNTRGFTPRKSRMGAMSVGNPSATAPRSASTKGRTLGKSPMSVTIAESPLGRAPTSLSTGGSTQERSHMHAGTVERPLPTAPPLPSTRELTLDKPTPHVLGT

SEQ ID NO: 816438 - protein, 145 aa, Homo sapiens
MELGSRRRSVGCRCRGLCLAVRRSRASRSCQKPGMTPGVRVSTDPEQVTFEDVVVDFSQEEWGQLKPAQRTLYRDVMLDTFRLLVSVGHWLPKPNVISLLEQEAELWAVESRLPQGVYPGEMGALRGREKPVHACFLVSPSASAL

SEQ ID NO: 816439 - protein, 1096 aa, Homo sapiens
MGSEDHGAQNPSCKIMTFRPTMEEFKDFNKYVAYIESQGAHRAGLAKIIPPKEWKPRQTYDDIDDVVIPAPIQQVVTGQSGLFTQYNIQKKAMTVGEYRRLANSEKYCTPRHQDFDDLERKYWKNLTFVSPIYGADISGSLYDDDVAQWNIGSLRTILDMVERECGTIIEGVNTPYLYFGMWKTTFAWHTEDMDLYSINYLHFGEPKSWYAIPPEHGKRLERLAIGFFPGSSQGCDAFLRHKMTLISPIILKKYGIPFSRITQEAGEFMITFPYGYHAGFNHGFNCAESTNFATLRWIDYGKVATQCTCRKDMVKISMDVFVRILQPERYELWKQGKDLTVLDHTRPTALTSPELSSWSASRASLKAKLLRRSHRKRSQPKKPKPEDPKFPGEGTAGAALLEEAGGSVKEEAGPEVDPEEEEEEPQPLPHGREAEGAEEDGRGKLRPTKAKSERKKKSFGLLPPQLPPPPAHFPSEEALWLPSPLEPPVLGPGPAAMEESPLPAPLNVVPPEVPSEELEAKPRPIIPMLYVVPRPGKAAFNQEHVSCQQAFEHFAQKGPTWKEPVSPMELTGPEDGAASSGAGRMETKARAGEGQAPSTFSKLKMEIKKSRRHPLGRPPTRSPLSVVKQEASSDEEASPFSGEEDVSDPDALRPLLSLQWKNRAASFQAERKFNAAAARTEPYCAICTLFYPYCQALQTEKEAPIASLGEGCPATLPSKSRQKTRPLIPEMCFTSGGENTEPLPANSYIGDDGTSPLIACGKCCLQVHASCYGIRPELVNEGWTCSRCAAHAWTAECCLCNLRGGALQMTTDRRWIHVICAIAVPEARFLNVIERHPVDISAIPEQRWKLKCVYCRKRMKKVSGACIQCSYEHCSTSFHVTCAHAAGVLMEPDDWPYVVSITCLKHKSGGHAVQLLRAVSLGQVVITKNRNGLYYRCRVIGAASQTCYEVNFDDGSYSDNLYPESITSRDCVQLGPPSEGELVELRWTDGNLYKAKFISSVTSHIYQVEFEDGSQLTVKRGDIFTLEEELPKRVRSRLSLSTGAPQEPAFSGEEAKAAKRPRVGTPLATEDSGRSQDYVAFVESLLQVQGRPGAPF

SEQ ID NO: 816440 - protein, 630 aa, Homo sapiens
GSRPKLFFFRSLLALVGRSLPPVLGPGPAAMEESPLPAPLNVVPPEVPSEELEAKPRPIIPMLYVVPRPGKAAFNQEHVSCQQAFEHFAQKGPTWKEPVSPMELTGPEDGAASSGAGRMETKARAGEGQAPSTFSKLKMEIKKSRRHPLGRPPTRSPLSVVKQEASSDEEASPFSGEEDVSDPDALRPLLSLQWKNRAASFQAERKFNAAAARTEPYCAICTLFYPYCQALQTEKEAPIASLGEGCPATLPSKSRQKTRPLIPEMCFTSGGENTEPLPANSYIGDDGTSPLIACGKCCLQVHASCYGIRPELVNEGWTCSRCAAHAWTAECCLCNLRGGALQMTTDRRWIHVICAIAVPEARFLNVIERHPVDISAIPEQRWKLKCVYCRKRMKKVSGACIQCSYEHCSTSFHVTCAHAAGVLMEPDDWPYVVSITCLKHKSGGHAVQLLRAVSLGQVVITKNRNGLYYRCRVIGAASQTCYEVNFDDGSYSDNLYPESITSRDCVQLGPPSEGELVELRWTDGNLYKAKFISSVTSHIYQVEFEDGSQLTVKRGDIFTLEEELPKRVRSRLSLSTGAPQEPAFSGEEAKAAKRPRVGTPLATEDSGRSQDYVAFVESLLQVQGRPGAPF

SEQ ID NO: 816441 - protein, 1130 aa, Homo sapiens
MGSEDHGAQNPSCKIMTFRPTMEEFKDFNKYVAYIESQGAHRAGLAKIIPPKEWKPRQTYDDIDDVVIPAPIQQVVTGQSGLFTQYNIQKKAMTVGEYRRLANSEKYCTPRHQDFDDLERKYWKNLTFVSPIYGADISGSLYDDDVAQWNIGSLRTILDMVERECGTIIEGVNTPYLYFGMWKTTFAWHTEDMDLYSINYLHFGEPKSWYAIPPEHGKRLERLAIGFFPGSSQGCDAFLRHKMTLISPIILKKYGIPFSRITQEAGEFMITFPYGYHAGFNHGFNCAESTNFATLRWIDYGKVATQCTCRKDMVKISMDVFVRILQPERYELWKQGKDLTVLDHTRPTALTSPELSSWSASRASLKAKLLRRQISLKENRHWRKTEEERKPSLERKKEQTKRPGLSSHRKRSQPKKPKPEDPKFPGEGTAGAALLEEAGGSVKEEAGPEVDPEEEEEEPQPLPHGREAEGAEEDGRGKLRPTKAKSERKKKSFGLLPPQLPPPPAHFPSEEALWLPSPLEPPVLGPGPAAMEESPLPAPLNVVPPEVPSEELEAKPRPIIPMLYVVPRPGKAAFNQEHVSCQQAFEHFAQKGPTWKEPVSPMELTGPEDGAASSGAGRMETKARAGEGQAPSTFSKLKMEIKKSRRHPLGRPPTRSPLSVVKQEASSDEEASPFSGEEDVSDPDALRPLLSLQWKNRAASFQAERKFNAAAARTEPYCAICTLFYPYCQALQTEKEAPIASLGEGCPATLPSKSRQKTRPLIPEMCFTSGGENTEPLPANSYIGDDGTSPLIACGKCCLQVHASCYGIRPELVNEGWTCSRCAAHAWTAECCLCNLRGGALQMTTDRRWIHVICAIAVPEARFLNVIERHPVDISAIPEQRWKLKCVYCRKRMKKVSGACIQCSYEHCSTSFHVTCAHAAGVLMEPDDWPYVVSITCLKHKSGGHAVQLLRAVSLGQVVITKNRNGLYYRCRVIGAASQTCYEVNFDDGSYSDNLYPESITSRDCVQLGPPSEGELVELRWTDGNLYKAKFISSVTSHIYQVEFEDGSQLTVKRGDIFTLEEELPKRVRSRLSLSTGAPQEPAFSGEEAKAAKRPRVGTPLATEDSGRSQDYVAFVESLLQVQGRPGAPF

SEQ ID NO: 816442 - protein, 770 aa, Homo sapiens
MGAFFFNTSICLQISLKENRHWRKTEEERKPSLERKKEQTKRPGLSSHRKRSQPKKPKPEDPKFPGEGTAGAALLEEAGGSVKEEAGPEVDPEEEEEEPQPLPHGREAEGAEEDGRGKLRPTKAKSERKKKSFGLLPPQLPPPPAHFPSEEALWLPSPLEPPVLGPGPAAMEESPLPAPLNVVPPEVPSEELEAKPRPIIPMLYVVPRPGKAAFNQEHVSCQQAFEHFAQKGPTWKEPVSPMELTGPEDGAASSGAGRMETKARAGEGQAPSTFSKLKMEIKKSRRHPLGRPPTRSPLSVVKQEASSDEEASPFSGEEDVSDPDALRPLLSLQWKNRAASFQAERKFNAAAARTEPYCAICTLFYPYCQALQTEKEAPIASLGEGCPATLPSKSRQKTRPLIPEMCFTSGGENTEPLPANSYIGDDGTSPLIACGKCCLQVHASCYGIRPELVNEGWTCSRCAAHAWTAECCLCNLRGGALQMTTDRRWIHVICAIAVPEARFLNVIERHPVDISAIPEQRWKLKCVYCRKRMKKVSGACIQCSYEHCSTSFHVTCAHAAGVLMEPDDWPYVVSITCLKHKSGGHAVQLLRAVSLGQVVITKNRNGLYYRCRVIGAASQTCYEVNFDDGSYSDNLYPESITSRDCVQLGPPSEGELVELRWTDGNLYKAKFISSVTSHIYQVEFEDGSQLTVKRGDIFTLEEELPKRVRSRLSLSTGAPQEPAFSGEEAKAAKRPRVGTPLATEDSGRSQDYVAFVESLLQVQGRPGAPF

SEQ ID NO: 816443 - protein, 131 aa, Homo sapiens [sequence omitted]

SEQ ID NO: 816444 - protein, 1130 aa, Homo sapiens; identical to SEQ ID NO: 816441

SEQ ID NO: 816445 - protein, 503 aa, Homo sapiens
MGSEDHGAQNPSCKIMTFRPTMEEFKDFNKYVAYIESQGAHRAGLAKIIPPKEWKPRQTYDDIDDVVIPAPIQQVVTGQSGLFTQYNIQKKAMTVGEYRRLANSEKYCTPRHQDFDDLERKYWKNLTFVSPIYGADISGSLYDDDVAQWNIGSLRTILDMVERECGTIIEGVNTPYLYFGMWKTTFAWHTEDMDLYSINYLHFGEPKSWYAIPPEHGKRLERLAIGFFPGSSQGCDAFLRHKMTLISPIILKKYGIPFSRITQEAGEFMITFPYGYHAGFNHGFNCAESTNFATLRWIDYGKVATQCTCRKDMVKISMDVFVRILQPERYELWKQGKDLTVLDHTRPTALTSPELSSWSASRASLKAKLLRRQISLKENRHWRKTEEERKPSLERKKEQTKRPGLSSHRKRSQPKKPKPEDPKFPGEGTAGAALLEEAGGSVKEEAGPEVDPEEEEEEPQPLPHGSRARRARGPARGAPHSTTQNFKPCKLSSSRKGATAMPY

SEQ ID NO: 816446 - protein, 131 aa, Homo sapiens [sequence omitted]

SEQ ID NO: 816447 - protein, 1130 aa, Homo sapiens; identical to SEQ ID NO: 816441

SEQ ID NO: 816448 - protein, 1130 aa, Homo sapiens; identical to SEQ ID NO: 816441

SEQ ID NO: 816449 - protein, 1130 aa, Homo sapiens; identical to SEQ ID NO: 816441

SEQ ID NO: 816450 - protein, 911 aa, Homo sapiens
MGSEDHGAQNPSCKIMTFRPTMEEFKDFNKYVAYIESQGAHRAGLAKIIPPKEWKPRQTYDDIDDVVIPAPIQQVVTGQSGLFTQYNIQKKAMTVGEYRRLANSEKYCTPRHQDFDDLERKYWKNLTFVSPIYGADISGSLYDDDVAQWNIGSLRTILDMVERECGTIIEGVNTPYLYFGMWKTTFAWHTEDMDLYSINYLHFGEPKSWYAIPPEHGKRLERLAIGFFPGSSQGCDAFLRHKMTLISPIILKKYGIPFSRITQEAGEFMITFPYGYHAGFNHGFNCAESTNFATLRWIDYGKVATQCTCRKDMVKISMDVFVRILQPERYELWKQGKDLTVLDHTRPTALTSPELSSWSASRASLKAKLLRRQISLKENRHWRKTEEERKPSLERKKEQTKRPGLSSHRKRSQPKKPKPEDPKFPGEGTAGAALLEEAGGSVKEEAGPEVDPEEEEEEPQPLPHGREAEGAEEDGRGKLRPTKAKSERKKKSFGLLPPQLPPPPAHFPSEEALWLPSPLEPPVLGPGPAAMEESPLPAPLNVVPPEVPSEELEAKPRPIIPMLYVVPRPGKAAFNQEHVSCQQAFEHFAQKGPTWKEPVSPMELTGPEDGAASSGAGRMETKARAGEGQAPSTFSKLKMEIKKSRRHPLGRPPTRSPLSVVKQEASSDEEASPFSGEEDVSDPDALRPLLSLQWKNRAASFQAERKFNAAAARTEPYCAICTLFYPYCQALQTEKEAPIASLGEGCPATLPSKSRQKTRPLIPEMCFTSGGENTEPLPANSYIGDDGTSPLIACGKCCLQVHASCYGIRPELVNEGWTCSRCAAHAWTAECCLCNLRGGALQMTTDRRWIHVICAIAVPEARFLNVIERHPVDISAIPEQRWKLVRSLGPGGAWPIMAWAAALQGCLLHTL

SEQ ID NO: 816451 - protein, 1130 aa, Homo sapiens; identical to SEQ ID NO: 816441

SEQ ID NO: 816452 - protein, 357 aa, Homo sapiens
MGSEDHGAQNPSCKIMTFRPTMEEFKDFNKYVAYIESQGAHRAGLAKIIPPKEWKPRQTYDDIDDVVIPAPIQQVVTGQSGLFTQYNIQKKAMTVGEYRRLANSEKYCTPRHQDFDDLERKYWKNLTFVSPIYGADISGSLYDDDVAQWNIGSLRTILDMVERECGTIIEGVNTPYLYFGMWKTTFAWHTEDMDLYSINYLHFGEPKSWYAIPPEHGKRLERLAIGFFPGSSQGCDAFLRHKMTLISPIILKKYGIPFSRITQEAGEFMITFPYGYHAGFNHGFNCAESTNFATLRWIDYGKVATQGQGVGGLASSGARFHQPENALPLMAKMVSPLCEYTSSCVAHLVNCRAHESH

SEQ ID NO: 816453 - protein, 569 aa, Homo sapiens
MAMESTATAAVAAELVSADKIEDVPAPSTSADKVESLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEETEGSEEDDKENDKTEEMPNDSVLENKSLQENEEEEIGNLELAWDMLDLAKIIFKRQETKEAQLYAAQAHLKLGEVSVESENYVQAVGGVPVLP

SEQ ID NO: 816454 - protein, 230 aa, Homo sapiens
MAMESTATAAVAAELVSADKIEDVPAPSTSADKVESLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDETEGSEEDDKENDKTEEMPNDSVLENKSLQENEEEEIGNLELAWDMLDLAKIIFKRQETKEAQLYAAQAHLKLGEVSVESENYVQAVGGVPVLP

SEQ ID NO: 816455 - protein, 230 aa, Homo sapiens; identical to SEQ ID NO: 816454

SEQ ID NO: 816456 - protein, 230 aa, Homo sapiens; identical to SEQ ID NO: 816454

SEQ ID NO: 816457 - protein, 230 aa, Homo sapiens; identical to SEQ ID NO: 816454

SEQ ID NO: 816458 - protein, 230 aa, Homo sapiens; identical to SEQ ID NO: 816454

SEQ ID NO: 816459 - protein, 230 aa, Homo sapiens; identical to SEQ ID NO: 816454

SEQ ID NO: 816460 - protein, 230 aa, Homo sapiens; identical to SEQ ID NO: 816454

SEQ ID NO: 816461 - protein, 230 aa, Homo sapiens; identical to SEQ ID NO: 816454

SEQ ID NO: 816462 - protein, 230 aa, Homo sapiens; identical to SEQ ID NO: 816454

SEQ ID NO: 816463 - protein, 230 aa, Homo sapiens; identical to SEQ ID NO: 816454

SEQ ID NO: 816464 - protein, 230 aa, Homo sapiens; identical to SEQ ID NO: 816454

SEQ ID NO: 816465 - protein, 230 aa, Homo sapiens; identical to SEQ ID NO: 816454

SEQ ID NO: 816466 - protein, 571 aa, Homo sapiens
MFLLLLHLQIKWRATINLLSVTEDGLHFVEYYLNRIIHLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEETEGSEEDDKENDKTEEMPNDSVLENKSLQENEEEEIGNLELAWDMLDLAKIIFKRQETKEAQLYAAQAHLKLGEVSVESENYVQAVGGVPVLP

SEQ ID NO: 816467 - protein, 514 aa, Homo sapiens
MGDIPAAVNAFQEAASLLGKKYGETANECGEAFFFYGKSLLELARMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEETEGSEEDDKENDKTEEMPNDSVLENKSLQENEEEEIGNLELAWDMLDLAKIIFKRQETKEAQLYAAQAHLKLGEVSVESENYVQAVGGVPVLP

SEQ ID NO: 816468 - protein, 452 aa, Homo sapiens
MPLSLNSKTCLCFMFFNHVEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEETEGSEEDDKENDKTEEMPNDSVLENKSLQENEEEEIGNLELAWDMLDLAKIIFKRQETKEAQLYAAQAHLKLGEVSVESENYVQAVGGVPVLP

SEQ ID NO: 816469 - protein, 532 aa, Homo sapiens
MAMESTATAAVAAELVSADKIEDVPAPSTSADKVERGKKYGETANECGEAFFFYGKSLLELARMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEETEGSEEDDKENDKTEEMPNDSVLENKSLQENEEEEIGNLELAWDMLDLAKIIFKRQETKEAQLYAAQAHLKLGEVSVESENYVQAVGGVPVLP

SEQ ID NO: 816470 - protein, 232 aa, Homo sapiens
MFLLLLHLQIKWRATINLLSVTEDGLHFVEYYLNRIIHLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDETEGSEEDDKENDKTEEMPNDSVLENKSLQENEEEEIGNLELAWDMLDLAKIIFKRQETKEAQLYAAQAHLKLGEVSVESENYVQAVGGVPVLP

SEQ ID NO: 816471 - protein, 230 aa, Homo sapiens; identical to SEQ ID NO: 816454

SEQ ID NO: 816472 - protein, 249 aa, Homo sapiens
MLPRHILNSEKLVLNLKTMCKLWEEFQSCLNLQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALKATLVESSTSGFTPGGGGSSVSMIASRKPTDGASSSNCVTDISHLVRKKRKPEEESPRKDDAKKAKQEPEVNGGSGDAVPSGNEVSENMEEEAENQAESRAAVEGTVEAGATVESTAC

SEQ ID NO: 816473 - protein, 230 aa, Homo sapiens; identical to SEQ ID NO: 816454

SEQ ID NO: 816474 - protein, 249 aa, Homo sapiens; identical to SEQ ID NO: 816472

SEQ ID NO: 816475 - protein, 249 aa, Homo sapiens; identical to SEQ ID NO: 816472

SEQ ID NO: 816476 - protein, 249 aa, Homo sapiens; identical to SEQ ID NO: 816472

SEQ ID NO: 816477 - protein, 249 aa, Homo sapiens; identical to SEQ ID NO: 816472

SEQ ID NO: 816478 - protein, 494 aa, Homo sapiens
MAMESTATAAVAAELVSADKIEDVPAPSTSADKVESLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEGNRDMQELQWVEYILDLTH

SEQ ID NO: 816479 - protein, 494 aa, Homo sapiens; identical to SEQ ID NO: 816478

SEQ ID NO: 816480 - protein, 513 aa, Homo sapiens
MAMESTATAAVAAELVSADKIEDVPAPSTSADKVESLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEETEGSEEDDKENDKTEEMPNDSVLENKSLQEMRRRDWT

SEQ ID NO: 816481 - protein, 249 aa, Homo sapiens; identical to SEQ ID NO: 816472

SEQ ID NO: 816482 - protein, 249 aa, Homo sapiens; identical to SEQ ID NO: 816472

SEQ ID NO: 816483 - protein, 233 aa, Homo sapiens
MLPRHILNSEKLVLNLKTMCKLWEEFQSCLNLQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALKATLVESSTSGFTPGGGGSSVSMIASRKPTDGASSSNCVTDISHLVRKKRKPEEESPRKDDAKKAKQEPEVNGGSGDAVPSGNEVSENMEEEAGATVESTAC

SEQ ID NO: 816484 - protein, 166 aa, Homo sapiens
MAMESTATAAVAAELVSADKIEDVPAPSTSADKVESLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDGYVELHVTFKRCDVVYFLYTVVETGLYLSW

SEQ ID NO: 816485 - protein, 147 aa, Homo sapiens
MAMESTATAAVAAELVSADKIEDVPAPSTSADKVESLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDGKPATRVPSSI

SEQ ID NO: 816486 - protein, 71 aa, Homo sapiens
PGALNPPGALNPPGALNPPGALNPPGALNPPGALNPPGALNPPEPLPLRKCFAVVFLKTLSTFVKPSQLYL

SEQ ID NO: 816487 - protein, 403 aa, Homo sapiens
MATGGGAEEERKRGRPQLLPPARPAARGEEADGGREKMGWAQVVKNLAEKKGEFREPRPPRREEESGGGGGSAGLGGPAGLAAPDLGDFPPAGRGDPKGRRRDPAGEAVDPRKKKGAAEAGRRKKAEAAAAAMATPARPGEAEDAAERPLQDEPAAAAGPGKGRFLVRICFQGDEGACPTRDFVVGALILRSIGMDPSDIYAVIQIPGSREFDVSFRSAEKLALFLRVYEEKREQEDCWENFVVLGRSKSSLKTLFILFRNETVDVEDIVTWLKRHCDVLAVPVKVTDRFGIWTGEYKCEIELRQGEGGVRHLPGAFFLGAERGYSWYKGQPKTCFKCGSRTHMSGSCTQDRCFRCGEEGHLSPYCRKGIVCNLCGKRGHAFAQCPKAVHNSVAAQLTGVAGH

SEQ ID NO: 816488 - protein, 403 aa, Homo sapiens; identical to SEQ ID NO: 816487

SEQ ID NO: 816489 - protein, 403 aa, Homo sapiens; identical to SEQ ID NO: 816487

SEQ ID NO: 816490 - protein, 403 aa, Homo sapiens; identical to SEQ ID NO: 816487

SEQ ID NO: 816491 - protein, 403 aa, Homo sapiens; identical to SEQ ID NO: 816487

SEQ ID NO: 816492 - protein, 403 aa, Homo sapiens; identical to SEQ ID NO: 816487

SEQ ID NO: 816493 - protein, 1372 aa, Homo sapiens
PAPAPTPPGPAPAPARAPALVPVPARVGSVPCGQVPPLCRRRPGPPARPLATMELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETVILHQGRLLGLRANKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 816494 - protein, 1372 aa, Homo sapiens; identical to SEQ ID NO: 816493

SEQ ID NO: 816495 - protein, 1177 aa, Homo sapiens
MSPGCMLLFVFGFVGGAVVINSAILVSLSVLLLVHFSISTGVPALTQNLPRILRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETVILHQGRLLGLRANKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 816496 - protein, 1019 aa, Homo sapiens
FLPLNDIQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETVILHQGRLLGLRANKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 816497 - protein, 1372 aa, Homo sapiens; identical to SEQ ID NO: 816493

SEQ ID NO: 816498 - protein, 1372 aa, Homo sapiens; identical to SEQ ID NO: 816493

SEQ ID NO: 816499 - protein, 1372 aa, Homo sapiens; identical to SEQ ID NO: 816493

SEQ ID NO: 816500 - protein, 1372 aa, Homo sapiens; identical to SEQ ID NO: 816493

SEQ ID NO: 816501 - protein, 1372 aa, Homo sapiens; identical to SEQ ID NO: 816493

SEQ ID NO: 816502 - protein, 1328 aa, Homo sapiens
PAPAPTPPGPAPAPARAPALVPVPARVGSVPCGQVPPLCRRRPGPPARPLATMELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETVILHQGRLLGLRANKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 816503 - protein, 1359 aa, Homo sapiens
PAPAPTPPGPAPAPARAPALVPVPARVGSVPCGQVPPLCRRRPGPPARPLATMELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 816504 - protein, 282 aa, Homo sapiens
MTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETVILHQGRLLGLRANKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 816505 - protein, 1017 aa, Homo sapiens
PAPAPTPPGPAPAPARAPALVPVPARVGSVPCGQVPPLCRRRPGPPARPLATMELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNG

SEQ ID NO: 816506 - protein, 1372 aa, Homo sapiens; identical to SEQ ID NO: 816493

SEQ ID NO: 816507 - protein, 484 aa, Homo sapiens
MDCLSPGVQDQPGQHGETLSLPKKKNKINEPGVVAHACSPSYLGGSGGRMTWAQEVEVAVSLDSTMHSSLGDGARPCLKTDKQAKNEIKVWISLIFLLNKFFKTTMLQFFPSQASGKCVIYPFLSITLGKAKYDFFFVFLRRSLALLPRLECSGAISAHCNLHLSGSSSSPASASQVAGITGVCHPAQLIFVFLVETGFRHVGQAGLKLLTSDDLPALASLKCLNYRREPPPPVRSKAKCNFMYCFNSINLWDKGPQSSEGLLKRKESKRRCQIVQTFLSTTDFFFLDYYYKDVCKKYTSGFYAYTRLGYIVKYMGFHEPEEAFGSIGPHVTISTLCTQYNCSHSCIKTVFGKSCIKRIIFCLSYLVTFLQGTKMRLLFHSLFAMFLFHLKSEPFLAISFKKSLLNIYWKCCKIHKKETPKCLGILIPRSKHPRVRSHLLLFSHVCMTECNLGNQELEMKNTNMSNGCNCFFELTGFNLSNIGV

SEQ ID NO: 816508 - protein, 326 aa, Homo sapiens
PAPAPTPPGPAPAPARAPALVPVPARVGSVPCGQVPPLCRRRPGPPARPLATMELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKVSNSPEPQKAVEQEVRMVLLNILQKVY

SEQ ID NO: 816509 - protein, 728 aa, Homo sapiens
MSPGCMLLFVFGFVGGAVVINSAILVSLSVLLLVHFSISTGVPALTQNLPRILRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEEKQHLISAPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVCTPAWVTEQDPVSKQTNKQKID

SEQ ID NO: 816510 - protein, 1046 aa, Homo sapiens
PAPAPTPPGPAPAPARAPALVPVPARVGSVPCGQVPPLCRRRPGPPARPLATMELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVV

SEQ ID NO: 816511 - protein, 1372 aa, Homo sapiens; identical to SEQ ID NO: 816493

SEQ ID NO: 816512 - protein, 983 aa, Homo sapiens
PAPAPTPPGPAPAPARAPALVPVPARVGSVPCGQVPPLCRRRPGPPARPLATMELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSRYNNGSST

SEQ ID NO: 816513 - protein, 1372 aa, Homo sapiens; identical to SEQ ID NO: 816493

SEQ ID NO: 816514 - protein, 1218 aa, Homo sapiens
PAPAPTPPGPAPAPARAPALVPVPARVGSVPCGQVPPLCRRRPGPPARPLATMELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTESKYIFR

SEQ ID NO: 816515 - protein, 1076 aa, Homo sapiens
PAPAPTPPGPAPAPARAPALVPVPARVGSVPCGQVPPLCRRRPGPPARPLATMELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGGDWQYYS

SEQ ID NO: 816516 - protein, 983 aa, Homo sapiens; identical to SEQ ID NO: 816512

SEQ ID NO: 816517 - protein, 362 aa, Homo sapiens
MENQVLTPHVYWAQRHRELYLRVELSDVQNPAISITENVLHFKAQGHGAKGDNVYEFHLEFLDLVKPEPVYKLTQRQVNITVQKKVSQWWERLTKQEKRPLFLAPDFDRWLDESDAEMELRAKEEERLNKLRLESEGSPETLTNLRKGYLFMYNLVQFLGFSWIFVNLTVRFCILGKESFYDTFHTVADMMYFCQMLAVVETINAAIGVTTSPVLPSLIQLLGRNFILFIIFGTMEEMQNKAVVFFVFYLWSAIEIFRYSFYMLTCIDMDWKVLTWLRYTLWIPLYPLGCLAEAVSVIQSIPIFNETGRFSFTLPYPVKIKVRFSFFLQIYLIMIFLGLYINFRHLYKQRRRRYGQKKKKIH

SEQ ID NO: 816518 - protein, 362 aa, Homo sapiens; identical to SEQ ID NO: 816517

SEQ ID NO: 816519 - protein, 362 aa, Homo sapiens; identical to SEQ ID NO: 816517

SEQ ID NO: 816520 - protein, 362 aa, Homo sapiens; identical to SEQ ID NO: 816517

SEQ ID NO: 816521 - protein, 362 aa, Homo sapiens; identical to SEQ ID NO: 816517

SEQ ID NO: 816522 - protein, 362 aa, Homo sapiens; identical to SEQ ID NO: 816517

SEQ ID NO: 816523 - protein, 362 aa, Homo sapiens; identical to SEQ ID NO: 816517

SEQ ID NO: 816524 - protein, 352 aa, Homo sapiens
SAEVGRSQGQEIKTILANMNPAISITENVLHFKAQGHGAKGDNVYEFHLEFLDLVKPEPVYKLTQRQVNITVQKKVSQWWERLTKQEKRPLFLAPDFDRWLDESDAEMELRAKEEERLNKLRLESEGSPETLTNLRKGYLFMYNLVQFLGFSWIFVNLTVRFCILGKESFYDTFHTVADMMYFCQMLAVVETINAAIGVTTSPVLPSLIQLLGRNFILFIIFGTMEEMQNKAVVFFVFYLWSAIEIFRYSFYMLTCIDMDWKVLTWLRYTLWIPLYPLGCLAEAVSVIQSIPIFNETGRFSFTLPYPVKIKVRFSFFLQIYLIMIFLGLYINFRHLYKQRRRRYGQKKKKIH

SEQ ID NO: 816525 - protein, 245 aa, Homo sapiens
MELRAKEEERLNKLRLESEGSPETLTNLRKGYLFMYNLVQFLGFSWIFVNLTVRFCILGKESFYDTFHTVADMMYFCQMLAVVETINAAIGVTTSPVLPSLIQLLGRNFILFIIFGTMEEMQNKAVVFFVFYLWSAIEIFRYSFYMLTCIDMDWKVLTWLRYTLWIPLYPLGCLAEAVSVIQSIPIFNETGRFSFTLPYPVKIKVRFSFFLQIYLIMIFLGLYINFRHLYKQRRRRYGQKKKKIH

SEQ ID NO: 816526 - protein, 325 aa, Homo sapiens
MENQVLTPHVYWAQRHRELYLRVELSDVQNPAISITENVLHFKAQGHGAKGDNVYEFHLEFLDLVKPEPVYKLTQRQVNITVQKKVSQWWERLTKQEKRPLFLAPDFDRWLDESDAEMELRAKEEERLNKLRLESEGSPEKSFYDTFHTVADMMYFCQMLAVVETINAAIGVTTSPVLPSLIQLLGRNFILFIIFGTMEEMQNKAVVFFVFYLWSAIEIFRYSFYMLTCIDMDWKVLTWLRYTLWIPLYPLGCLAEAVSVIQSIPIFNETGRFSFTLPYPVKIKVRFSFFLQIYLIMIFLGLYINFRHLYKQRRRRYGQKKKKIH

SEQ ID NO: 816527 - protein, 362 aa, Homo sapiens; identical to SEQ ID NO: 816517

SEQ ID NO: 816528 - protein, 362 aa, Homo sapiens; identical to SEQ ID NO: 816517

SEQ ID NO: 816529 - protein, 370 aa, Homo sapiens [sequence omitted]

SEQ ID NO: 816530 - protein, 130 aa, Homo sapiens
MENQVLTPHVYWAQRHRELYLRVELSDVQNPAISITENVLHFKAQGHGAKGDNVYEFHLEFLDLVKPEPVYKLTQRQVNITVQKKVSQWWERLTKQEKRPLFLAPDFDRWLDESDAEMELRAKVSKDPRI

SEQ ID NO: 816531 - protein, 83 aa, Homo sapiens
RVTAQARPGSVGYLEVPGCRRSGALGFEACFLLAPAEHYLRQRGAASLASPRPGQCGHGESGVDAACLLGSATPRAISARGAE

SEQ ID NO: 816532 - protein, 297 aa, Homo sapiens
ACLAELPLPALQALSLWRLGFGREKEGPSAGRAGARWAAAMALSCTLNRYLLLMAQEHLEFRLPEIKSLLLLFGGQFASSQETYGKSPFWILSIPSEDIARNLMKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNTSMDAGLSFIMANHGKVKENDIVFDPFVGTGGLLIACAHFGAYVYGTDIDYNTVHGLACST

SEQ ID NO: 816533 - protein, 503 aa, Homo sapiens
ACLAELPLPALQALSLWRLGFGREKEGPSAGRAGARWAAAMALSCTLNRYLLLMAQEHLEFRLPEIKSLLLLFGGQFASSQETYGKSPFWILSIPSEDIARNLMKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNTSMDAGLSFIMANHGKVKENDIVFDPFVGTGGLLIACAHFGAYVYGTDIDYNTVHGLGKATRKNQKWRGPDENIRANLRQYGLEKYYLDVLVSDASKPSWRKGTYFDAIITDPPYGIRESTRRTGSQKEIPKGIEKWEKCPESHVPVSLSYHLSDMFLDLLNFAAETLVLGGRLVYWLPVYTPEYTEEMVPWHPCLELVSNCEQKLSSHTSRRLITMEKVKKFENRDQYSHLLSDHFLPYQGHNSFREKYFSGVTKRIAKEEKSTQE

SEQ ID NO: 816534 - protein, 270 aa, Homo sapiens
ACLAELPLPALQALSLWRLGFGREKEGPSAGRAGARWAAAMALSCTLNRYLLLMAQEHLEFRLPEIKSLLLLFGGQFASSQETYGKSPFWILSIPSEDIARNLMKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNTSMDAGLSFIMANHGKVKENDIVFDPFVGTAVYL

SEQ ID NO: 816535 - protein, 270 aa, Homo sapiens; identical to SEQ ID NO: 816534

SEQ ID NO: 816536 - protein, 270 aa, Homo sapiens; identical to SEQ ID NO: 816534

SEQ ID NO: 816537 - protein, 400 aa, Homo sapiens
MKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNTSMDAGLSFIMANHGKVKENDIVFDPFVGTGGLLIACAHFGAYVYGTDIDYNTVHGLGKATRKNQKWRGPDENIRANLRQYGLEKYYLDVLVSDASKPSWRKGTYFDAIITDPPYGIRESTRRTGSQKEIPKGIEKWEKCPESHVPVSLSYHLSDMFLDLLNFAAETLVLGGRLVYWLPVYTPEYTEEMVPWHPCLELVSNCEQKLSSHTSRRLITMEKVKKFENRDQYSHLLSDHFLPYQGHNSFREKYFSGVTKRIAKEEKSTQE

SEQ ID NO: 816538 - protein, 400 aa, Homo sapiens; identical to SEQ ID NO: 816537

SEQ ID NO: 816539 - protein, 400 aa, Homo sapiens; identical to SEQ ID NO: 816537

SEQ ID NO: 816540 - protein, 244 aa, Homo sapiens
ACLAELPLPALQALSLWRLGFGREKEGPSAGRAGARWAAAMALSCTLNRYLLLMAQEHLEFRLPEIKSLLLLFGGQFASSQETYGKSPFWILSIPSEDIARNLMKRTVCAKSIFELWGHGQSPEELYSSLKNYPVEKMVPFLHSDSTYKIKIHTFNKTLTQEEKIKRIDALEFLPFEGKVNLKKPQHVFSVLEDYGLDPNCIPENPHNIYFGRWIADGQRELIESYSVKKRHFIGNTSMDAEIF

SEQ ID NO: 816541 - protein, 1819 aa, Homo sapiens
MASITQLFDDLCEALLPAAKTHLGQRSVNRKRAKRSLKKVAYNALFTNLFQDETQQLQPDMSKLPARNKILMLSFDLRVGGLGPKADRLEELVEELEAAPCCPLLEVGSVLDLLVQLAGSGPPQVLPRKRDYFLNNKHVGRNVPYSGYDCDDLSVFEMDVQSLISREECLCHSMIQETLQVMEAAPGTGLPTVGLFSFGDPCGDRFERDTRVSLFGALVHSRTYDMDVRLGLPPVPDNADLSGLAIKVPPSVDQWEDEGFQSASNLTPDSQSEPSVTPDVDLWEAALTYEASKRRCWERVGCPPGHREEPYLTEAGRDAFDKFCRLHQGELQLLAGGVLQAPQPVLVKECELVKDVLNVLIGVVSATFSLCQPAQAFVVKRGVHVSGASPESISSLLSEVAEYGTCYTRLSHFSLQPVLDSLYSKGLVFQAFTSGLRRYLQYYRACVLSTPPTLSLLTIGFLFKKLGRQLRYLAELCGVGAVLPGTCGGGPRAAFPTGVKLLSYLYQEALHNCSNEHYPVLLSLLKTSCEPYTRFIHDWVYSGVFRDAYGEFMIQVNHEYLSFRDKSYWTHGYVLISKEVEDCVPVFLKHIAHDIYVCGKTINLLKLCCPRHYLCWSDVPVPRISVIFSLEELKEIEKDCAVYVGRMERVARHSSVSKEEKELRMEIAKQELIAHAREAASRVLSALSDRQMSERMALDARKREQFQRLKEQFVKDQERRQAARQEELDDDFSYARELRDRERRLKSLEEELERKARQALVDHYSKLSAEAARREQKALWRIQRHRLESARLRFLLEDEKHIQEMLKAVSEAHQPQEPPDVLLSVHPQVTSPGPEHPEGGQGCDSGSAEQHSPAWDGWNRPGLLTPQPLKPLAVGAGGRGLQQAEGARPFSDSLSIGDFLPVGPGAEPSVQTGMVPLLEVALQTINLDLPPSAPGEAPAAASTQPSRPQEYDFSTVLRPAVATSPAPGPLQAAECSLGSSGLQLWEDSCGKMDACGSASRETLLPSHPPRRAALEEGSSQPTERLFGQVSGGGLPTGDYASEIAPTRPRWNTHGHVSDASIRVGENVSDVAPTQPRWNTHGHVSNASISLGESVSDVAPTRPRWNIHGHVSNASIRVGENVSDVAPTRPRWNTHGHVSNASIRVGENVSDVAPTRPRWNTHGHVSDASISLGESVSDMAPARPRWNTHGHVSDASISLGESVSDMAPTRPRWNTHGHVSDTSIRVGENVSDVAPIRSRCNTHGHVSDASISLGEPVSDVVSTRPRWNTHVPIPPPHMVLGALSPEAEPNTPRPQQSPPGHTSQSALSLGAQSTVLDCGPRLPVEVGPSLSSPSSGCGEGSISVGENVSDVAPTQPWWPNTPGDSVSEELGPGRSGDAEDLSPNWPLNSQEDTAAQSSPGRGEEAEASAAEAQGGEQAYLAGLAGQYHLERYPDSYESMSEPPIAHLLRPVLPRAFAFPVDPQVQSAADETAVQLSELLTLPVLMKRSITAPLAAHISLVNKAAVDYFFVELHLEAHYEALRHFLLMEDGEFAQSLSDLLFEKLGAGQTPGELLNPLVLNSVLSKALQCSLHGDTPHASNLSLALKYLPEVFAPNAPDVLSCLELRYKVDWPLNIVITEGCLSKYSGVFSFLLQLKLMMWALKDVCFHLKRTALLSHMAGSVQFRQLQLFKHEMQHFVKVIQGYIANQILHVTWCEFRARLATVGDLEEIQRAHAEYLHKAVFRGLLTEKAAPVMNVIHSIFSLVLKFRSQLISQAWGPPGGPRGAEHPNFALMQQSYNTFKYYSHFLFKVVTKLVNRGYQPHLEDFLLRINFNNYYQDA

SEQ ID NO: 816542 - protein, 1801 aa, Homo sapiens
MASITQLFDDLCEALLPAAKTHLGQRSVNRKRAKRSLKKVAYNALFTNLFQDETQQLQPDMSKLPARNKILMLSFDLRVGGLGPKADRLEELVEELEAAPCCPLLEVGSVLDLLVQLAGSGPPQVLPRKRDYFLNNKHVGRNVPYSGYDCDDLSVFEMDVQSLISREECLCHSMIQETLQVMEAAPGTGLPTVGLFSFGDPCGDRFERDTRVSLFGALVHSRTYDMDVRLGLPPVPDNADLSGLAIKVPPSVDQWEDEGFQSASNLTPDSQSEPSVTPDVDLWEAALTYEASKRRCWERVGCPPGHREEPYLTEAGRDAFDKFCRLHQGELQLLAGGVLQAPQPVLVKECELVKDVLNVLIGVVSATFSLCQPAQAFVVKRGVHVSGASPESISSLLSEVAEYGTCYTRLSHFSLQPVLDSLYSKGLVFQAFTSGLRRYLQYYRACVLSTPPTLSLLTIGFLFKKLGRQLRYLAELCGVGAVLPGTCGGGPRAAFPTGVKLLSYLYQEALHNCSNEHYPVLLSLLKTSCEPYTRFIHDWVYSGVFRDAYGEFMIQVNHEYLSFRDKSYWTHGYVLISKEVEDCVPVFLKHIAHDIYVCGKTINLLKLCCPRHYLCWSDVPVPRISVIFSLEELKEIEKDCAVYVGRMERVARHSSVSKEEKELRMEIAKQELIAHAREAASRVLSALSDRQMSERMALDARKREQFQRLKEQFVKDQERRQAARQEELDDDFSYARELRDRERRLKSLEEELERKARQALVDHYSKLSAEAARREQKALWRIQRHRLESARLRFLLEDEKHIQEMLKAVSEAHQPQEPPDVLLSVHPQVTSPGPEHPEGGQGCDSGSAEQHSPAWDGWNRPGLLTPQPLKPLAVGAGGRGLQQAEGARPFSDSLSIGDFLPVGPGAEPSVQTGMVPLLEVALQTINLDLPPSAPGEAPAAASTQPSRPQEYDFSTVLRPAVATSPAPGPLQAAECSLGSSGLQLWEDSCGKMDACGSASRETLLPSHPPRRAALEEGSSQPTERLFGQVSGGGLPTGDYASEIAPTRPRWNTHGHVSDASIRVGENVSDVAPTQPRWNTHGHVSNASISLGESVSDVAPTRPRWNIHGHVSNASIRVGENVSDVAPTRPRWNTHGHVSNASIRVGENVSDVAPTRPRWNTHGHVSDASISLGESVSDMAPARPRWNTHGHVSDASISLGESVSDMAPTRPRWNTHGHVSDTSIRVGENVSDVAPIRSRCNTHGHVSDASISLGEPVSDVVSTRPRWNTHVPIPPPHMVLGALSPEAEPNTPRPQQSPPGHTSQSALSLGAQSTVLDCGPRLPVEVGPSLSSPSSGCGEGSISVGENVSDVAPTQPWWPNTPGDSVSEELGQSRVAGGQEWDCGTHRAWEVGGQWGWWHVKFPSGLLVSQDLGCCGGHGRGCLSQGRLGSYPPQALGPDALVSTCVHTGPGRSGDAEDLSPNWPLNSQEDTAAQSSPGRGEEAEASAAEAQGGEQAYLAGLAGQYHLERYPDSYESMSEPPIAHLLRPVLPRAFAFPVDPQVQSAADETAVQLSELLTLPVLMKRSITAPLAAHISLVNKAAVDYFFVELHLEAHYEALRHFLLMEDGEFAQSLSDLLFEKLGAGQTPGELLNPLVLNSVLSKALQCSLHGDTPHASNLSLALKYLPEVFAPNAPDVLSCLELRYKVDWPLNIVITEGCLSKYSGVFSFLLQLKLMMWALKDVCFHLKRTALLSHMAGSVQFRQLQLFKHEMQHFVKVIQGYIANQILHVTWCEFRARLATVGDLEEIQRAHAEYLHKAVFR

SEQ ID NO: 816543 - protein, 1341 aa, Homo sapiens
HRGVHPTLDKSYWTHGYVLISKEVEDCVPVFLKHIAHDIYVCGKTINLLKLCCPRHYLCWSDVPVPRISVIFSLEELKEIEKDCAVYVGRMERVARHSSVSKEEKELRMEIAKQELIAHAREAASRVLSALSDRQMSERMALDARKREQFQRLKEQFVKDQERRQAARQEELDDDFSYARELRDRERRLKSLEEELERKARQALVDHYSKLSAEAARREQKALWRIQRHRLESARLRFLLEDEKHIQEMLKAVSEAHQPQEPPDVLLSVHPQVTSPGPEHPEGGQGCDSGSAEQHSPAWDGWNRPGLLTPQPLKPLAVGAGGRGLQQAEGARPFSDSLSIGDFLPVGPGAEPSVQTGMVPLLEVALQTINLDLPPSAPGEAPAAASTQPSRPQEYDFSTVLRPAVATSPAPGPLQAAECSLGSSGLQLWEDSCGKMDACGSASRETLLPSHPPRRAALEEGSSQPTERLFGQVSGGGLPTGDYASEIAPTRPRWNTHGHVSDASIRVGENVSDVAPTQPRWNTHGHVSNASISLGESVSDVAPTRPRWNIHGHVSNASIRVGENVSDVAPTRPRWNTHGHVSNASIRVGENVSDVAPTRPRWNTHGHVSDASISLGESVSDMAPARPRWNTHGHVSDASISLGESVSDMAPTRPRWNTHGHVSDTSIRVGENVSDVAPIRSRCNTHGHVSDASISLGEPVSDVVSTRPRWNTHVPIPPPHMVLGALSPEAEPNTPRPQQSPPGHTSQSALSLGAQSTVLDCGPRLPVEVGPSLSSPSSGCGEGSISVGENVSDVAPTQPWWPNTPGDSVSEELGQSRVAGGQEWDCGTHRAWEVGGQWGWWHVKFPSGLLVSQDLGCCGGHGRGCLSQGRLGSVPATGTRPDALVSTCVHTGPGRSGDAEDLSPNWPLNSQEDTAAQSSPGRGEEAEASAAEAQGGEQAYLAGLAGQYHLERYPDSYESMSEPPIAHLLRPVLPRAFAFPVDPQVQSAADETAVQLSELLTLPVLMKRSITAPLAAHISLVNKAAVDYFFVELHLEAHYEALRHFLLMEDGEFAQSLSDLLFEKLGAGQTPGELLNPLVLNSVLSKALQCSLHGDTPHASNLSLALKYLPEVFAPNAPDVLSCLELRYKVDWPLNIVITEGCLSKYSGVFSFLLQLKLMMWALKDVCFHLKRTALLSHMAGSVQFRQLQLFKHEMQHFVKVIQGYIANQILHVTWCEFRARLATVGDLEEIQRAHAEYLHKAVFRGLLTEKAAPVMNVIHSIFSLVLKFRSQLISQAWGPPGGPRGAEHPNFALMQQSYNTFKYYSHFLFKVVTKLVNRGYQPHLEDFLLRINFNNYYQDA

SEQ ID NO: 816544 - protein, 1913 aa, Homo sapiens
MASITQLFDDLCEALLPAAKTHLGQRSVNRKRAKRSLKKVAYNALFTNLFQDETQQLQPDMSKLPARNKILMLSFDLRVGGLGPKADRLEELVEELEAAPCCPLLEVGSVLDLLVQLAGSGPPQVLPRKRDYFLNNKHVGRNVPYSGYDCDDLSVFEMDVQSLISREECLCHSMIQETLQVMEAAPGTGLPTVGLFSFGDPCGDRFERDTRVSLFGALVHSRTYDMDVRLGLPPVPDNADLSGLAIKVPPSVDQWEDEGFQSASNLTPDSQSEPSVTPDVDLWEAALTYEASKRSPPGHREEPYLTEAGRDAFDKFCRLHQGELQLLAGGVLQAPQPVLVKECELVKDVLNVLIGVVSATFSLCQPAQAFVVKRGVHVSGASPESISSLLSEVAEYGTCYTRLSHFSLQPVLDSLYSKGLVFQAFTSGLRRYLQYYRACVLSTPPTLSLLTIGFLFKKLGRQLRYLAELCGVGAVLPGTCGGGPRAAFPTGVKLLSYLYQEALHNCSNEHYPVLLSLLKTSCEPYTRFIHDWVYSGVFRDAYGEFMIQVNHEYLSFRDKSYWTHGYVLISKEVEDCVPVFLKHIAHDIYVCGKTINLLKLCCPRHYLCWSDVPVPRISVIFSLEELKEIEKDCAVYVGRMERVARHSSVSKEEKELRMEIAKQELIAHAREAASRVLSALSDRQMSERMALDARKREQFQRLKEQFVKDQERRQAARQEELDDDFSYARELRDRERRLKSLEEELERKARQALVDHYSKLSAEAARREQKALWRIQRHRLESARLRFLLEDEKHIQEMLKAVSEAHQPQEPPDVLLSVHPQVTSPGPEHPEGGQGCDSGSAEQHSPAWDGWNRPGLLTPQPLKPLAVGAGGRGLQQAEGARPFSDSLSIGDFLPVGPGAEPSVQTGMVPLLEVALQTINLDLPPSAPGEAPAAASTQPSRPQEYDFSTVLRPAVATSPAPGPLQAAECSLGSSGLQLWEDSCGKMDACGSASRETLLPSHPPRRAALEEGSSQPTERLFGQVSGGGLPTGDYASEIAPTRPRWNTHGHVSDASIRVGENVSDVAPTQPRWNTHGHVSNASISLGESVSDVAPTRPRWNIHGHVSNASIRVGENVSDVAPTRPRWNTHGHVSNASIRVGENVSDVAPTRPRWNTHGHVSDASISLGESVSDMAPARPRWNTHGHVSDASISLGESVSDMAPTRPRWNTHGHVSDTSIRVGENVSDVAPIRSRCNTHGHVSDASISLGEPVSDVVSTRPRWNTHVPIPPPHMVLGALSPEAEPNTPRPQQSPPGHTSQSALSLGAQSTVLDCGPRLPVEVGPSLSSPSSGCGEGSISVGENVSDVAPTQPWWPNTPGDSVSEELGQSRVAGGQEWDCGTHRAWEVGGQWGWWHVKFPSGLLVSQDLGCCGGHGRGCLSQGRLGSYPPQALGPDALVSTCVHTGPGRSGDAEDLSPNWPLNSQEDTAAQSSPGRGEEAEASAAEAQGGEQAYLAGLAGQYHLERYPDSYESMSEPPIAHLLRPVLPRAFAFPVDPQVQSAADETAVQLSELLTLPVLMKRSITAPLAAHISLVNKAAVDYFFVELHLEAHYEALRHFLLMEDGEFAQSLSDLLFEKLGAGQTPGELLNPLVLNSVLSKALQCSLHGDTPHASNLSLALKYLPEVFAPNAPDVLSCLELRYKVDWPLNIVITEGCLSKYSGVFSFLLQLKLMMWALKDVCFHLKRTALLSHMAGSVQFRQLQLFKHEMQHFVKVIQGYIANQILHVTWCEFRARLATVGDLEEIQRAHAEYLHKAVFSEAWAAAASLWSRLSPPSSTASPQGLLTEKAAPVMNVIHSIFSLVLKFRSQLISQAWGPPGGPRGAEHPNFALMQQSYNTFKYYSHFLFKVVTKLVNRGYQPHLEDFLLRINFNNYYQDA

SEQ ID NO: 816545 - protein, 1916 aa, Homo sapiens
MASITQLFDDLCEALLPAAKTHLGQRSVNRKRAKRSLKKVAYNALFTNLFQDETQQLQPDMSKLPARNKILMLSFDLRVGGLGPKADRLEELVEELEAAPCCPLLEVGSVLDLLVQLAGSGPPQVLPRKRDYFLNNKHVGRNVPYSGYDCDDLSVFEMDVQSLISREECLCHSMIQETLQVMEAAPGTGLPTVGLFSFGDPCGDRFERDTRVSLFGALVHSRTYDMDVRLGLPPVPDNADLSGLAIKVPPSVDQWEDEGFQSASNLTPDSQSEPSVTPDVDLWEAALTYEASKRSPPGHREEPYLTEAGRDAFDKFCRLHQGELQLLAGGVLQAPQPVLVKECELVKDVLNVLIGVVSATFSLCQPAQAFVVKRGVHVSGASPESISSLLSEVAEYGTCYTRLSHFSLQPVLDSLYSKGLVFQAFTSGLRRYLQYYRACVLSTPPTLSLLTIGFLFKKLGRQLRYLAELCGVGAVLPGTCGGGPRAAFPTGVKLLSYLYQEALHNCSNEHYPVLLSLLKTSCEPYTRFIHDWVYSGVFRDAYGEFMIQVNHEYLSFRDKSYWTHGYVLISKEVEDCVPVFLKHIAHDIYVCGKTINLLKLCCPRHYLCWSDVPVPRISVIFSLEELKEIEKDCAVYVGRMERVARHSSVSKEEKELRMEIAKQELIAHAREAASRVLSALSDRQMSERMALDARKREQFQRLKEQFVKDQERRQAARQEELDDDFSYARELRDRERRLKSLEEELERKARQALVDHYSKLSAEAARREQKALWRIQRHRLESARLRFLLEDEKHIQEMLKAVSEAHQPQEPPDVLLSVHPQVTSPGPEHPEGGQGCDSGSAEQHSPAWDGWNRPGLLTPQPLKPLAVGAGGRGLQQAEGARPFSDSLSIGDFLPVGPGAEPSVQTGMVPLLEVALQTINLDLPPSAPGEAPAAASTQPSRPQEYDFSTVLRPAVATSPAPGPLQAAECSLGSSGLQLWEDSCGKMDACGSASRETLLPSHPPRRAALEEGSSQPTERLFGQVSGGGLPTGDYASEIAPTRPRWNTHGHVSDASIRVGENVSDVAPTQPRWNTHGHVSNASISLGESVSDVAPTRPRWNIHGHVSNASIRVGENVSDVAPTRPRWNTHGHVSNASIRVGENVSDVAPTRPRWNTHGHVSDASISLGESVSDMAPARPRWNTHGHVSDASISLGESVSDMAPTRPRWNTHGHVSDTSIRVGENVSDVAPIRSRCNTHGHVSDASISLGEPVSDVVSTRPRWNTHVPIPPPHMVLGALSPEAEPNTPRPQQSPPGHTSQSALSLGAQSTVLDCGPRLPVEVGPSLSSPSSGCGEGSISVGENVSDVAPTQPWWPNTPGDSVSEELGQSRVAGGQEWDCGTHRAWEVGGQWGWWHVKFPSGLLVSQDLGCCGGHGRGCLSQGRLGSYPPQALGPDALVSTCVHTGPGRSGDAEDLSPNWPLNSQEDTAAQSSPGRGEEAEASAAEAQGGEQAYLAGLAGQYHLERYPDSYESMSEPPIAHLLRPVLPRAFAFPVDPQVQSAADETAVQLSELLTLPVLMKRSITAPLAAQECPCPCASLPTQPVLARPDSSSLLLSISLVNKAAVDYFFVELHLEAHYEALRHFLLMEDGEFAQSLSDLLFEKLGAGQTPGELLNPLVLNSVLSKALQCSLHGDTPHASNLSLALKYLPEVFAPNAPDVLSCLELRYKVDWPLNIVITEGCLSKYSGVFSFLLQLKLMMWALKDVCFHLKRTALLSHMAGSVQFRQLQLFKHEMQHFVKVIQGYIANQILHVTWCEFRARLATVGDLEEIQRAHAEYLHKAVFRGLLTEKAAPVMNVIHSIFSLVLKFRSQLISQAWGPPGGPRGAEHPNFALMQQSYNTFKYYSHFLFKVVTKLVNRGYQPHLEDFLLRINFNNYYQDA

SEQ ID NO: 816546 - protein, 750 aa, Homo sapiens
MASITQLFDDLCEALLPAAKTHLGQRSVNRKRAKRSLKKVAYNALFTNLFQDETQQLQPDMSKLPARNKILMLSFDLRVGGLGPKADRLEELVEELEAAPCCPLLEVGSVLDLLVQLAGSGPPQVLPRKRDYFLNNKHVGRNVPYSGYDCDDLSVFEMDVQSLISREECLCHSMIQETLQVMEAAPGTGLPTVGLFSFGDPCGDRFERDTRVSLFGALVHSRTYDMDVRLGLPPVPDNADLSGLAIKVPPSVDQWEDEGFQSASNLTPDSQSEPSVTPDVDLWEAALTYEASKRSPPGHREEPYLTEAGRDAFDKFCRLHQGELQLLAGGVLQAPQPVLVKECELVKDVLNVLIGVVSATFSLCQPAQAFVVKRGVHVSGASPESISSLLSEVAEYGTCYTRLSHFSLQPVLDSLYSKGLVFQAFTSGLRRYLQYYRACVLSTPPTLSLLTIGFLFKKLGRQLRYLAELCGVGAVLPGTCGGGPRAAFPTGVKLLSYLYQEALHNCSNEHYPVLLSLLKTSCEPYTRFIHDWVYSGVFRDAYGEFMIQVNHEYLSFRDKSYWTHGYVLISKEVEDCVPVFLKHIAHDIYVCGKTINLLKLCCPRHYLCWSDVPVPRISVIFSLEELKEIEKDCAVYVGRMERVARHSSVSKEEKELRMEIAKQELIAHAREAASRVLSALSDRQMSERMALDARKREQFQRLKEQFVKDQERRQAARQEELDDDFSYARELRDRERRLKSLEEELERKAR

SEQ ID NO: 816547 - protein, 750 aa, Homo sapiens; identical to SEQ ID NO: 816546

SEQ ID NO: 816548 - protein, 438 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816549 - protein, 438 aa, Homo sapiens; identical to SEQ ID NO: 816548

SEQ ID NO: 816550 - protein, 438 aa, Homo sapiens; identical to SEQ ID NO: 816548

SEQ ID NO: 816551 - protein, 438 aa, Homo sapiens; identical to SEQ ID NO: 816548

SEQ ID NO: 816552 - protein, 384 aa, Homo sapiens
MLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816553 - protein, 481 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYRGARAVGWEGAVVMQLPCPVGTGGSGMVPGGASSPPPNPNLRYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816554 - protein, 415 aa, Homo sapiens [sequence omitted]

SEQ ID NO: 816555 - protein, 469 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLVSEGSRRGVEVAIGAGTHTAPSISPVWYLLQFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816556 - protein, 489 aa, Homo sapiens
MGGCAGSRRRFSDSEGEYSRPPSWNDHLWLAAHLRGMRADSAPGGHARSGRAPESRWGSCPLLALPGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816557 - protein, 390 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPSYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816558 - protein, 223 aa, Homo sapiens
MLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816559 - protein, 115 aa, Homo sapiens
MLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816560 - protein, 339 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAPPGSRQWDLCCWKLRPGCLFSFCGDQPVCYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816561 - protein, 223 aa, Homo sapiens; identical to SEQ ID NO: 816558

SEQ ID NO: 816562 - protein, 315 aa, Homo sapiens
MGGCAGSRRRFSDSEGEETVPEPRLPLLDHQGAHWKNAVGFWLLGLCNNFSYVVMLSAAHDILSHKRTSGNQSHPPGSRQWDLCCWKLRPGCLFSFCGDQPVCYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816563 - protein, 282 aa, Homo sapiens
MRWEAVQARGGAFRIPRVDPGPTPIPHNSSSRFDCNSVSTAPPGSRQWDLCCWKLRPGCLFSFCGDQPVCYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816564 - protein, 381 aa, Homo sapiens
MWTQAQRRSPTTAHHDLTATLSLRLPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYRGARAVGWEGAVVMQLPCPVGTGGSGMVPGGASSPPPNPNLRYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816565 - protein, 253 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGSSSSLSLRERWTVFKGLLWYIVPLVVVYFAEYFINQGLFELLFFWNTSLSHAQQYRWYQMLYQAGVFASRSSLRCCRIRFTWALALLQMESRSVAQAGM

SEQ ID NO: 816566 - protein, 110 aa, Homo sapiens
MLSAAHDILSHKRTSGNQSHVDPGPTPIPHNSSSRFDCNSVSTAAVLLADILPTLVIKLLAPAPASPFGKGGQCSSLPALLILGILRTQVTFTCGQRDRSDTQAHPRDPP

SEQ ID NO: 816567 - protein, 338 aa, Homo sapiens
MWTQAQRRSPTTAHHDLTATLSLRLPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816568 - protein, 495 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKLDDGWGMSLWGLLTSRPPAYIFCLFQGLLWYIVPLVVVYFAEYFINQGLVSEGSRRGVEVAIGAGTHTAPSISPVWYLLQFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816569 - protein, 311 aa, Homo sapiens
MRWEAVQARGGAFRIPRGRRPSRSPGSLCWTIRARIGRTRWASGCAPGGHPPHTRHQIVGSSWPSPAALQPPGSRQWDLCCWKLRPGCLFSFCGDQPVCYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816570 - protein, 146 aa, Homo sapiens
MQLPCPVGTGGSGMVPGGASSPPPNPNLRYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816571 - protein, 285 aa, Homo sapiens
MLSAAHDILSHKRTSGNQSHVDPGPTPIPHNSSSRFDCNSVSTAPPGSRQWDLCCWKLRPGCLFSFCGDQPVCYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 816572 - protein, 115 aa, Homo sapiens; identical to SEQ ID NO: 816559

SEQ ID NO: 816573 - protein, 181 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCAISCCSHLLRPRTLEGKKKQRAQPGSPS

SEQ ID NO: 816574 - protein, 327 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPAPAQLSFGKGAGQGCGVHVPAEVLAENHTRAWNPLLESRRAERGQAPGVAPNRGHHRGRGAPVG

SEQ ID NO: 816575 - protein, 89 aa, Homo sapiens
ARHSPKSRDSRKRGVEAAHSPGEMTGLSMDGGGSPKGDVDPFYYDYETVRNGGLIFAGLAFIVGLLILLSRRFRCGGNKKRRQINEDEP

SEQ ID NO: 816576 - protein, 84 aa, Homo sapiens
PGKQHLPALLHSWTQPAAPAMDRWYLGGSPKGDVDPFYYDYETVRNGGLIFAGLAFIVGLLILLSRRFRCGGNKKRRQINEDEP

SEQ ID NO: 816577 - protein, 84 aa, Homo sapiens; identical to SEQ ID NO: 816576

SEQ ID NO: 816578 - protein, 102 aa, Homo sapiens
MDRWYLGGSPKGDVDPFYYDYETVRNGGLIFAGLAFIVGLLILLILPSEQKDFRLVVGPLRKAAEANSMEGLKPRLTSRASRRGCTPTCDIVVAQLVGKPRD

SEQ ID NO: 816579 - protein, 89 aa, Homo sapiens; identical to SEQ ID NO: 816575

SEQ ID NO: 816580 - protein, 89 aa, Homo sapiens; identical to SEQ ID NO: 816575

SEQ ID NO: 816581 - protein, 67 aa, Homo sapiens
AAERDSCWERPPIPLLLPSLSGDYETVRNGGLIFAGLAFIVGLLILLSRRFRCGGNKKRRQINEDEP

SEQ ID NO: 816582 - protein, 101 aa, Homo sapiens
GKQQPFAVLNLHFTCDTNRVSILPDEEVVCTVRAAVPNGEYVSISDYYFMTTDDAFLEMGEPCYSIRRRYMAFIVGLLILLSRRFRCGGNKKRRQINEDEP

SEQ ID NO: 816583 - protein, 89 aa, Homo sapiens; identical to SEQ ID NO: 816575

SEQ ID NO: 816584 - protein, 795 aa, Homo sapiens [sequence omitted]

SEQ ID NO: 816585 - protein, 795 aa, Homo sapiens [sequence omitted]

SEQ ID NO: 816586 - protein, 777 aa, Homo sapiens
MLSQVYRCGFQPFNQHLLPWVKCTTVFRSHCIQPSVIRHVRSWSNIPFITVPLSRTHGKSFAHRSELKHAKRIVVKLGSAVVTRGDECGLALGRLASIVEQVSVLQNQGREMMLVTSGAVAFGKQRLRHEILLSQSVRQALHSGQNQLKEMAIPVLEARACAAAGQSGLMALYEAMFTQYSICAAQILVTNLDFHDEQKRRNLNGTLHELLRMNIVPIVNTNDAVVPPAEPNSDLQGVNVISVKDNDSLAARLAVEMKTDLLIVLSDVEGLFDSPPGSDDAKLIDIFYPGDQQSVTFGTKSRVGMGGMEAKVKAALWALQGGTSVVIANGTHPKVSGHVITDIVEGKKVGTFFSEVKPAGPTVEQQGEMARSGGRMLATLEPEQRAEIIHHLADLLTDQRDEILLANKKDLEEAEGRLAAPLLKRLSLSTSKLNSLAIGLRQIAASSQDSVGRVLRRTRIAIESRPDCLPQVAALAIASGNGLLLKGGKEAAHSNRILHLLTQEALSIHGVKEAVQLVNTREEVEDLCRLDKMIDLIIPRGSSQLVRDIQKAAKGIPVMGHSEGICHMYVDSEASVDKVTRLVRDSKCEYPAACNALETLLIHRDLLRTPLFDQIIDMLRVEQVKIHAGPKFASYLTFSPSEVKSLRTEYGDLELCIEVVDNVQDAIDHIHKYGSSHTDVIVTEDENTAEFFLQHVDSACVFWNASTRFSDGYRFGLGAEVGISTSRIHARGPVGLEGLLTTKWLLRGKDHVVSDFSEHGSLKYLHENLPIPQRNTN

SEQ ID NO: 816587 - protein, 795 aa, Homo sapiens [sequence omitted]

SEQ ID NO: 816588 - protein, 795 aa, Homo sapiens [sequence omitted]

SEQ ID NO: 816589 - protein, 795 aa, Homo sapiens [sequence omitted]

SEQ ID NO: 816590 - protein, 761 aa, Homo sapiens
NFESPGQGLPVYYLVPLDFSNIYGKSFAHRSELKHAKRIVVKLGSAVVTRGDECGLALGRLASIVEQVSVLQNQGREMMLVTSGAVAFGKQRLRHEILLSQSVRQALHSGQNQLKEMAIPVLEARACAAAGQSGLMALYEAMFTQYSICAAQILVTNLDFHDEQKRRNLNGTLHELLRMNIVPIVNTNDAVVPPAEPNSDLQGVNVISVKDNDSLAARLAVEMKTDLLIVLSDVEGLFDSPPGSDDAKLIDIFYPGDQQSVTFGTKSRVGMGGMEAKVKAALWALQGGTSVVIANGTHPKVSGHVITDIVEGKKVGTFFSEVKPAGPTVEQQGEMARSGGRMLATLEPEQRAEIIHHLADLLTDQRDEILLANKKDLEEAEGRLAAPLLKRLSLSTSKLNSLAIGLRQIAASSQDSVGRVLRRTRIAKNLELEQVTVPIGVLLVIFESRPDCLPQVAALAIASGNGLLLKGGKEAAHSNRILHLLTQEALSIHGVKEAVQLVNTREEVEDLCRLDKMIDLIIPRGSSQLVRDIQKAAKGIPVMGHSEGICHMYVDSEASVDKVTRLVRDSKCEYPAACNALETLLIHRDLLRTPLFDQIIDMLRVEQVKIHAGPKFASYLTFSPSEVKSLRTEYGDLELCIEVVDNVQDAIDHIHKYGSSHTDVIVTEDENTAEFFLQHVDSACVFWNASTRFSDGYRFGLGAEVGISTSRIHARGPVGLEGLLTTKWLLRGKDHVVSDFSEHGSLKYLHENLPIPQRNTN

SEQ ID NO: 816591 - protein, 617 aa, Homo sapiens
KTWQDKRGYFGRRLIHAYADPCLELNGTLHELLRMNIVPIVNTNDAVVPPAEPNSDLQGVNVISVKDNDSLAARLAVEMKTDLLIVLSDVEGLFDSPPGSDDAKLIDIFYPGDQQSVTFGTKSRVGMGGMEAKVKAALWALQGGTSVVIANGTHPKVSGHVITDIVEGKKVGTFFSEVKPAGPTVEQQGEMARSGGRMLATLEPEQRAEIIHHLADLLTDQRDEILLANKKDLEEAEGRLAAPLLKRLSLSTSKLNSLAIGLRQIAASSQDSVGRVLRRTRIAKNLELEQVTVPIGVLLVIFESRPDCLPQVAALAIASGNGLLLKGGKEAAHSNRILHLLTQEALSIHGVKEAVQLVNTREEVEDLCRLDKMIDLIIPRGSSQLVRDIQKAAKGIPVMGHSEGICHMYVDSEASVDKVTRLVRDSKCEYPAACNALETLLIHRDLLRTPLFDQIIDMLRVEQVKIHAGPKFASYLTFSPSEVKSLRTEYGDLELCIEVVDNVQDAIDHIHKYGSSHTDVIVTEDENTAEFFLQHVDSACVFWNASTRFSDGYRFGLGAEVGISTSRIHARGPVGLEGLLTTKWLLRGKDHVVSDFSEHGSLKYLHENLPIPQRNTN

SEQ ID NO: 816592 - protein, 539 aa, Homo sapiens [sequence omitted]

SEQ ID NO: 816593 - protein, 491 aa, Homo sapiens [sequence omitted]

SEQ ID NO: 816594 - protein, 795 aa, Homo sapiens [sequence omitted]

SEQ ID NO: 816595 - protein, 400 aa, Homo sapiens
MMDQRDEILLANKKDLEEAEGRLAAPLLKRLSLSTSKLNSLAIGLRQIAASSQDSVGRVLRRTRIAKNLELEQVTVPIGVLLVIFESRPDCLPQVAALAIASGNGLLLKGGKEAAHSNRILHLLTQEALSIHGVKEAVQLVNTREEVEDLCRLDKMIDLIIPRGSSQLVRDIQKAAKGIPVMGHSEGICHMYVDSEASVDKVTRLVRDSKCEYPAACNALETLLIHRDLLRTPLFDQIIDMLRVEQVKIHAGPKFASYLTFSPSEVKSLRTEYGDLELCIEVVDNVQDAIDHIHKYGSSHTDVIVTEDENTAEFFLQHVDSACVFWNASTRFSDGYRFGLGAEVGISTSRIHARGPVGLEGLLTTKWLLRGKDHVVSDFSEHGSLKYLHENLPIPQRNTN

SEQ ID NO: 816596 - protein, 245 aa, Homo sapiens
MIDLIIPRGSSQLVRDIQKAAKGIPVMGHSEGICHMYVDSEASVDKVTRLVRDSKCEYPAACNALETLLIHRDLLRTPLFDQIIDMLRVEQVKIHAGPKFASYLTFSPSEVKSLRTEYGDLELCIEVVDNVQDAIDHIHKYGSSHTDVIVTEDENTAEFFLQHVDSACVFWNASTRFSDGYRFGLGAEVGISTSRIHARGPVGLEGLLTTKWLLRGKDHVVSDFSEHGSLKYLHENLPIPQRNTN

SEQ ID NO: 816597 - protein, 54 aa, Homo sapiens
EGICHMYVDSEASVDKVTRLGELDGVFSFTTEKYYILCSSGSCQWKQFFAHLLS

SEQ ID NO: 816598 - protein, 165 aa, Homo sapiens
MAGTALKRLMAEYKQLTLNPPEGIVAGPMNEENFFEWEALIMGPEDTCFEFGVFPAILSFPLDYPLSPPKMRFTCEMFHPNIYPDGRVCISILHAPGDDPMGYESSAERWSPVQSVEKILLSVVSMLAEPNDESGANVDASKMWRDDREQFYKIAKQIVQKSLGL

SEQ ID NO: 816599 - protein, 165 aa, Homo sapiens; identical to SEQ ID NO: 816598

SEQ ID NO: 816600 - protein, 165 aa, Homo sapiens; identical to SEQ ID NO: 816598

SEQ ID NO: 816601 - protein, 165 aa, Homo sapiens; identical to SEQ ID NO: 816598

SEQ ID NO: 816602 - protein, 137 aa, Homo sapiens
MNEENFFEWEALIMGPEDTCFEFGVFPAILSFPLDYPLSPPKMRFTCEMFHPNIYPDGRVCISILHAPGDDPMGYESSAERWSPVQSVEKILLSVVSMLAEPNDESGANVDASKMWRDDREQFYKIAKQIVQKSLGL

SEQ ID NO: 816603 - protein, 164 aa, Homo sapiens
RKQSPVSGQEARARLRRGRSAQLLRGHGGDRAQEADGRVQTGPEDTCFEFGVFPAILSFPLDYPLSPPKMRFTCEMFHPNIYPDGRVCISILHAPGDDPMGYESSAERWSPVQSVEKILLSVVSMLAEPNDESGANVDASKMWRDDREQFYKIAKQIVQKSLGL

SEQ ID NO: 816604 - protein, 128 aa, Homo sapiens
MPQLCKQLGCCVCSLCSHYLWSLPKRGDASGTIPGLTWLPLTLAVYPDGRVCISILHAPGDDPMGYESSAERWSPVQSVEKILLSVVSMLAEPNDESGANVDASKMWRDDREQFYKIAKQIVQKSLGL

SEQ ID NO: 816605 - protein, 198 aa, Homo sapiens
MAGTALKRLMAEYKQLTLNPPEGIVAGPMNEENFFEWEALIMGPEDTCFEFGVFPAILSFPLDYPLSPPKMRFTCEMFHPNMSPYGTNSWRRQHRSGKLPDFVDGILGGQPDVQVYPDGRVCISILHAPGDDPMGYESSAERWSPVQSVEKILLSVVSMLAEPNDESGANVDASKMWRDDREQFYKIAKQIVQKSLGL

SEQ ID NO: 816606 - protein, 165 aa, Homo sapiens; identical to SEQ ID NO: 816598

SEQ ID NO: 816607 - protein, 111 aa, Homo sapiens
MAGTALKRLMAEYKQLTLNPPEGIVAGPMNEENFFEWEALIMGPEDTCFEFGVFPAILSFPLDYPLSPPKMRFTCEMFHPNMSPYGTNSWRRQHRSGKLPDFVDVDLRWTA

SEQ ID NO: 816608 - protein, 92 aa, Homo sapiens
MNKDAQMRAAINQKLIETGERERLKELLRAKLIECGWKDQLKAHCKEVIKEKGLEHVTVRYQALPFGVISATKSSTVTVELAANLVVVVVGG

SEQ ID NO: 816609 - protein, 106 aa, Homo sapiens
MVVSKMNKDAQMRAAINQKLIETGERERLKELLRAKLIECGWKDQLKAHCKEVIKEKGLEHVTVDDLVAEITPKGREHSLLSMPAFKIELDCVVVVLFLKVKLAIN

SEQ ID NO: 816610 - protein, 133 aa, Homo sapiens
MSGGGATQLLNGPMAKRSQTQLSGPPADICRSPPIRGVRNHIRIRPRFTLAIKNSREPGKPPGQHERQAAPRHPPCTTTRNARTNDSDIHDPNHTHQHRTTHSTTPPTTTPQHAQPPHDAAHHPPHAHLNTIR

SEQ ID NO: 816611 - protein, 133 aa, Homo sapiens; identical to SEQ ID NO: 816610

SEQ ID NO: 816612 - protein, 272 aa, Homo sapiens
AAPWSRSLQAASLRRWRWAWRCRRLGADAGGGVPGFRGVRPGAGLPGPGDCRSCGSRGSVGDASRDGAGGTGERSAACSLFPLSGGRVGHHLRAGLPAGPPLRQRPAPCGLSDQAGQSRSRRCPRPWGRKRPGLAGPGLWCLRPGLGSPPPPASPGRAELPSRAHCEVTSCRRALAPGPRRPERLLQPVAAPSPAAPLRPSREGCEACSWGPSSGAAPRKGLIFHLATSATGRQDRIQFRLLLGKGPRGKGEAGRKQLGPPSLRGLQDIRRG

SEQ ID NO: 816613 - protein, 445 aa, Homo sapiens [sequence omitted]

SEQ ID NO: 816614 - protein, 445 aa, Homo sapiens [sequence omitted]

SEQ ID NO: 816615 - protein, 488 aa, Homo sapiens
MRFHWLPTLSEPFDRNQELETCIRPLWTPSGSACETEHNKSMDMGNQHPSISRLQEIQKEVKSVEQQVIGFSGLSDDKNYKKLERILTKQLFEIDSVDTEGKGDIQQARKRAAQETERLLKELEQNANHPHRIEIQNIFEEAQSLVREKIVPFYNGGNCVTDEFEEGIQDIILRLTHVKTGGKISLRKARYHTLTKICAVQEIIEDCMKKQPSLPLSEDAHPSVAKINFVMCEVNKARGVLIALLMGVNNNETCRHLSCVLSGLIADLDALDVCGRTEIRNYRREVVEDINKLLKYLDLEEEADTTKAFDLRQNHSILKIEKVLKRMREIKNELLQAQNPSELYLSSKTELQGLIGQLDEVSLEKNPCIREARRRAVIEVQTLITYIDLKEALEKRKLFACEEHPSHKAVWNVLGNLSEIQGEVLSFDGNRTDKNYIRLEELLTKQLLALDAVDPQGEEKCKAARKQAVRLAQNILSYLDLKSDEWEY

SEQ ID NO: 816616 - protein, 482 aa, Homo sapiens
IADSRGYTLVPPNNRRRIWRWPGRDSACETEHNKSMDMGNQHPSISRLQEIQKEVKSVEQQVIGFSGLSDDKNYKKLERILTKQLFEIDSVDTEGKGDIQQARKRAAQETERLLKELEQNANHPHRIEIQNIFEEAQSLVREKIVPFYNGGNCVTDEFEEGIQDIILRLTHVKTGGKISLRKARYHTLTKICAVQEIIEDCMKKQPSLPLSEDAHPSVAKINFVMCEVNKARGVLIALLMGVNNNETCRHLSCVLSGLIADLDALDVCGRTEIRNYRREVVEDINKLLKYLDLEEEADTTKAFDLRQNHSILKIEKVLKRMREIKNELLQAQNPSELYLSSKTELQGLIGQLDEVSLEKNPCIREARRRAVIEVQTLITYIDLKEALEKRKLFACEEHPSHKAVWNVLGNLSEIQGEVLSFDGNRTDKNYIRLEELLTKQLLALDAVDPQGEEKCKAARKQAVRLAQNILSYLDLKSDEWEY

SEQ ID NO: 816617 - protein, 445 aa, Homo sapiens [sequence omitted]

SEQ ID NO: 816618 - protein, 100 aa, Homo sapiens
AAPWSRSLQAASLRRWRWAWRCRRLGADAGGGVPGFRGVRPGAGLPGPGDCRSCGSRGSVGDASRDGAGGTVLVKLNTTKVWIWETNILLLVGFRKSKRK

SEQ ID NO: 816619 - protein, 445 aa, Homo sapiens [sequence omitted]

SEQ ID NO: 816620 - protein, 445 aa, Homo sapiens [sequence omitted]

SEQ ID NO: 816621 - protein, 100 aa, Homo sapiens; identical to SEQ ID NO: 816618

SEQ ID NO: 816622 - protein, 302 aa, Homo sapiens
LPALLTLASAGSCPCARGSLRMPGPRRLRSPGGSGCSSRGSGPRLSTRRWRPCCYCGGSGVWLLRTPPSPSAWPARRCPRHRFEFCEPAFVVGNCLQIASDSHQYDRIYCGAGVQKDHENYMKILLKVGGILVMPIEDQLTQIMRTGQNTWESKNILAVSFAPLVQPSKNDNGKPDSVGLPPCAVRNLQDLARIYIRRTLRNFINDEMQAKGIPQRAPPKRKRKRVKQRINTYVFVGNQLIPQPLDSEEDEKMEEDNKEEEEKDHNEAMKPEEPPQNLLREKIMKLPLPESLKAYLTYFRDK

SEQ ID NO: 816623 - protein, 267 aa, Homo sapiens
MGGAVSAGEDNDDLIDNLKEAQYIRTERVEQAFRAIDRGDYYLEGYRDNAYKDLAWKHGNIHLSAPCIYSEVMEALKLQPGLSFLNLGSGTGYLSTMVGLILGPFGINHGIELHSDVVEYAKEKLESFIKNSDSFDKRRSRALGAVRPLGQRRCLPTRSSELRRRPAGKMSGSSARSSHLSQPVVKSVLVYRNGDPFYAGRRVVIHEKKVSSFEVFLKEVTGGVQAPFGAVRNIYTPRTGHRIRKLDQIQSGGNYVAGGQEAFKKLK

SEQ ID NO: 816624 - protein, 108 aa, Homo sapiens
MGGAVSAGEDNDDLIDNLKEAQYIRTERVEQAFRAIDRGDYYLEGYRDNAYKDLAWKHGNIHLSAPCIYSEVMEALKLQPGLSFLNLGSGTGYLSTMVGLILGTRTQC

SEQ ID NO: 816625 - protein, 137 aa, Homo sapiens
MGGAVSAGEDNDDLIDNLKEAQYIRTERVEQAFRAIDRGDYYLEGYRDNAYKDLAWKHGNIHLSAPCIYSEVMEALKLQPGLSFLNLGSGTGYLSTMVGLILGPFGINHGIELHSDVVEYAKEKLESFIKNSDSFDK

SEQ ID NO: 816626 - protein, 138 aa, Homo sapiens
MGGAVSAGEDNDDLIDNLKEAQYIRTERVEQAFRAIDRGDYYLEGYRDNAYKDLAWKHGNIHLSAPCIYSEVMEALKLQPGLSFLNLGSGTGYLSTMVGLILGPFGINHGIELHSDVVEYAKEKLESFIKNSDSFDNY

SEQ ID NO: 816627 - protein, 357 aa, Homo sapiens
MGGAVSAGEDNDDLIDNLKEAQYIRTERVEQAFRAIDRGDYYLEGYRDNAYKDLAWKHGNIHLSAPCIYSEVMEALKLQPGLSFLNLGSGTGYLSTMVGLILGPFGINHGIELHSDVVEYAKEKLESFIKNSDSFDKFEFCEPAFVVGNCLQIASDSHQYDRIYCGAGVQKDHENYMKILLKVGGILVMPIEDQLTQIMRTGQNTWESKNILAVSFAPLVQPSKNDNGKPDSVGLPPCAVRNLQDLARIYIRRTLRNFINDEMQAKGIPQRAPPKRKRKRVKQRINTYVFVGNQLIPQPLDSEEDEKMEEDNKEEEEKDHNEAMKPEEPPQNLLREKIMKLPLPESLKAYLTYFRDK

SEQ ID NO: 816628 - protein, 169 aa, Homo sapiens [sequence omitted]

SEQ ID NO: 816629 - protein, 357 aa, Homo sapiens; identical to SEQ ID NO: 816627

SEQ ID NO: 816630 - protein, 357 aa, Homo sapiens; identical to SEQ ID NO: 816627

SEQ ID NO: 816631 - protein, 357 aa, Homo sapiens; identical to SEQ ID NO: 816627

SEQ ID NO: 816632 - protein, 357 aa, Homo sapiens; identical to SEQ ID NO: 816627

SEQ ID NO: 816633 - protein, 357 aa, Homo sapiens; identical to SEQ ID NO: 816627

SEQ ID NO: 816634 - protein, 238 aa, Homo sapiens
MGGAVSAGEDNDDLIDNLKEAQYIRTERVEQAFRAIDRGDYYLEGYRDNAYKDLAWKHGNIHLSAPCIYSEVMEALKLQPGLSFLNLGSGTGYLSTMVGLILGPFGINHGIELHSDVVEYAKEKLESFIKNSDSFDKFEFCEPAFVVGNCLQIASDSHQYDRIYCGAGVQKDHENYMKILLKVGGILVMPIEDQLTQIMRTGQNTWESKNILAVSFAPLVQPSKNDNGKPDSVGLHLG

SEQ ID NO: 816635 - protein, 111 aa, Homo sapiens
MGGAVSAGEDNDDLIDNLKEAQYIRTERVEQAFRAIDRGDYYLEGYRDNAYKDLAWKHGNIHLSAPCIYSEVMEALKLQPGLSFLNLGSGTGYLSTMVGLILGYFDLRVLN

SEQ ID NO: 816636 - protein, 807 aa, Homo sapiens
RSRKGWIKDKDRPTKSSMRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQLSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPSLGSVS

SEQ ID NO: 816637 - protein, 987 aa, Homo sapiens [sequence omitted]

SEQ ID NO: 816638 - protein, 981 aa, Homo sapiens
MGNHSGRPEDPEPGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQLSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYANIDITNFSSSWSDGLAFCALLHTYLPAHIPYQELNSQEKKRNLLLAFEAAESVGIKPSLELSEMLYTDRRRRGREFSSKTGN

SEQ ID NO: 816639 - protein, 948 aa, Homo sapiens
MGNHSGRPEDPEPGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQLSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYAKRNLLLAFEAAESVGIKPSLELSEMLYTDRPDWQSVMQYVAQIYKYFET

SEQ ID NO: 816640 - protein, 1068 aa, Homo sapiens [sequence omitted]

SEQ ID NO: 816641 - protein, 999 aa, Homo sapiens
MACSEDKNYYKANGEIKHVSSLLAKGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQLSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYANIDITNFSSSWSDGLAFCALLHTYLPAHIPYQELNSQEKKRNLLLAFEAAESVGIKPSLELSEMLYTDRPDWQSVMQYVAQIYKYFET

SEQ ID NO: 816642 - protein, 709 aa, Homo sapiens [sequence omitted]

SEQ ID NO: 816643 - protein, 732 aa, Homo sapiens
LGVVKLHNNQLISELERGVINAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYANIDITNFSSSWSDGLAFCALLHTYLPAHIPYQELNSQEKKRNLLLAFEAAESVGIKPSLELSEMLYTDRPDWQSVMQYVAQIYKYFET

SEQ ID NO: 816644 - protein, 508 aa, Homo sapiens
NCKAPGPFFDWSGPAGRNRLASRSQRELGTVDTRSEAGKPAGARVGQAWATTQDGPRIRNQVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYANIDITNFSSSWSDGLAFCALLHTYLPAHIPYQELNSQEKKRNLLLAFEAAESVGIKPSLELSEMLYTDRPDWQSVMQYVAQIYKYFET

SEQ ID NO: 816645 - protein, 130 aa, Homo sapiens
MKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPSLGSVS

SEQ ID NO: 816646 - protein, 271 aa, Homo sapiens
MTRWARVSTTYNKRPLPATSWEDMKKGSFEGTSQNLPKRKQLEANRLSLKNDAPQAKHKKNKKKKEYLNEDVNGFMEYLRQNSQMVHNGQIIATDSEEVREEIAVALKKDSRREGRRLKRQAAKKNAMVCFHCRKPGHGIADCPAALENQDMGTGICYRCGSTEHEITKCKAKVDPALGEFPFAKCFVCGEMGHLSRSCPDNPKGLYADGGGCKLCGSVEHLKKDCPESQNSERMVTVGRWAKGMSADYEEILDVPKPQKPKTKIPKVVNF

SEQ ID NO: 816647 - protein, 271 aa, Homo sapiens; identical to SEQ ID NO: 816646

SEQ ID NO: 816648 - protein, 308 aa, Homo sapiens
ALGHYVLPVSNTAGGRSSPARQLGCSGGFVRGTTDEIMTRWARVSTTYNKRPLPATSWEDMKKGSFEGTSQNLPKRKQLEANRLSLKNDAPQAKHKKNKKKKEYLNEDVNGFMEYLRQNSQMVHNGQIIATDSEEVREEIAVALKKDSRREGRRLKRQAAKKNAMVCFHCRKPGHGIADCPAALENQDMGTGICYRCGSTEHEITKCKAKVDPALGEFPFAKCFVCGEMGHLSRSCPDNPKGLYADGGGCKLCGSVEHLKKDCPESQNSERMVTVGRWAKGMSADYEEILDVPKPQKPKTKIPKVVNF

SEQ ID NO: 816649 - protein, 271 aa, Homo sapiens; identical to SEQ ID NO: 816646

SEQ ID NO: 816650 - protein, 195 aa, Homo sapiens
MTRWARVSTTYNKRPLPATSWEDMKKGSFEGTSQNLPKRKQLEANRLSLKNDAPQAKHKKNKKKKEYLNEDVNGFMEYLRQNSQMVHNGQIIATDSEEVREEIAVALKKDSRREGRRLKRQAAKKNAMVCFHCRKPGHGIADCPAALENQDMGTGICYRCGSTEHEITKCKAKVDPALGMCFFQFFVLFMGKANK

SEQ ID NO: 816651 - protein, 120 aa, Homo sapiens
MGTGICYRCGSTEHEITKCKAKVDPALGEFPFAKCFVCGEMGHLSRSCPDNPKGLYADGGGCKLCGSVEHLKKDCPESQNSERMVTVGRWAKGMSADYEEILDVPKPQKPKTKIPKVVNF

SEQ ID NO: 816652 - protein, 175 aa, Homo sapiens
ALSGTMCFRSPIPQEGGLPRLANSAALGDSCAVCFHCRKPGHGIADCPAALENQDMGTGICYRCGSTEHEITKCKAKVDPALGEFPFAKCFVCGEMGHLSRSCPDNPKGLYADGGGCKLCGSVEHLKKDCPESQNSERMVTVGRWAKGMSADYEEILDVPKPQKPKTKIPKVVNF

SEQ ID NO: 816653 - protein, 153 aa, Homo sapiens
ALGHYVLPVSNTAGGRSSPARQLGCSGGFVRGKKLRGSAVRCGSTEHEITKCKAKVDPALGEFPFAKCFVCGEMGHLSRSCPDNPKGLYADGGGCKLCGSVEHLKKDCPESQNSERMVTVGRWAKGMSADYEEILDVPKPQKPKTKIPKVVNF

SEQ ID NO: 816654 - protein, 172 aa, Homo sapiens [sequence omitted]

SEQ ID NO: 816655 - protein, 172 aa, Homo sapiens [sequence omitted]

SEQ ID NO: 816656 - protein, 79 aa, Homo sapiens
ALGHYVLPVSNTAGGRSSPARQLGCSGGFVRGKKLRGSAVRCVSIVENLVMELQIAPPPLKIKTWALGYVTGVGPQSTK

SEQ ID NO: 816657 - protein, 295 aa, Homo sapiens
MIEVLTTTDSQKLLHQLNALLEQESRCQPKVCGLRLIESAHDNGLRMTARLRDFEVKDLLSLTQFFGFDTETFSLAVNLLDRFLSKMKVQPKHLGCVGLSCFYLAVKSIEEERNVPLATDLIRISQYRFTVSDLMRMEKIVLEKVCWKVKATTAFQFLQLYYSLLQENLPLERRNSINFERLEAQLKACHCRIIFSKAKPSVLALSIIALEIQAQKCVELTEGIECLQKHSKINGRDLTFWQELVSKCLTEYSSNKCSKPNVQKLKWIVSGRTARQLKHSYYRITHLPTIPEMVP

SEQ ID NO: 816658 - protein, 295 aa, Homo sapiens; identical to SEQ ID NO: 816657

SEQ ID NO: 816659 - protein, 295 aa, Homo sapiens; identical to SEQ ID NO: 816657

SEQ ID NO: 816660 - protein, 280 aa, Homo sapiens
MIEVLTTTDSQKLLHQLNALLEQESRCQPKVCGLRLIESAHDNGLRMTARLRDFEVKDLLSLTQFFGFDTETFSLAVNLLDRFLSKMKVQPKHLGCVGLSCFYLAVKSIEEERNVPLATDLIRISQYRFTVSDLMRMEKIVLEKVCWKVKATTAFQFLQLYYSLLQENLPLERRNSINFERLEAQLKACHCRIIFSKAKPSVLALSIIALEIQAQKCVELTEGIECLQKHSKINGRDLTFWQELVSKCLTEYSSNKCSKPNVQKLKWIVSGRTARQLKHS

SEQ ID NO: 816661 - protein, 295 aa, Homo sapiens; identical to SEQ ID NO: 816657

SEQ ID NO: 816662 - protein, 295 aa, Homo sapiens; identical to SEQ ID NO: 816657

SEQ ID NO: 816663 - protein, 295 aa, Homo sapiens; identical to SEQ ID NO: 816657

SEQ ID NO: 816664 - protein, 295 aa, Homo sapiens; identical to SEQ ID NO: 816657

SEQ ID NO: 816665 - protein, 295 aa, Homo sapiens; identical to SEQ ID NO: 816657

SEQ ID NO: 816666 - protein, 241 aa, Homo sapiens
MIEVLTTTDSQKLLHQLNALLEQESRCQPKVCGLRLIESAHDNGLRMTARLRDFEVKDLLSLTQFFGFDTETFSLAVNLLDRFLSKMKVQPKHLGCVGLSCFYLAVKSIEEERNVPLATDLIRISQYRFTVSDLMRMEKIVLEKVCWKVKATTAFQFLQLYYSLLQENLPLERRNSINFERLEAQLKACHCRIIFSKAKPSVLALSIIALEIQAQKCVELTEGIECLQKHSKDYYSTKKLL

SEQ ID NO: 816667 - protein, 295 aa, Homo sapiens; identical to SEQ ID NO: 816657

SEQ ID NO: 816668 - protein, 277 aa, Homo sapiens
MIEVLTTTDSQKLLHQLNALLEQESRCQPKVCGLRLIESAHDNGLRMTARLRDFEVKDLLSLTQFFGFDTETFSLAVNLLDRFLSKMKVQPKHLGCVGLSCFYLAVKSIEEERNVPLATDLIRISQYRFTVSDLMRMEFLQLYYSLLQENLPLERRNSINFERLEAQLKACHCRIIFSKAKPSVLALSIIALEIQAQKCVELTEGIECLQKHSKINGRDLTFWQELVSKCLTEYSSNKCSKPNVQKLKWIVSGRTARQLKHSYYRITHLPTIPEMVP

SEQ ID NO: 816669 - protein, 295 aa, Homo sapiens; identical to SEQ ID NO: 816657

SEQ ID NO: 816670 - protein, 1207 aa, Homo sapiens
CQGDGSFPELLVLPIGDVEPLLVEGLSGRRDPLGDPTMFFYLSKKISIPNNVKLQCVSWNKEQGFIACGGEDGLLKVLKLETQTDDAKLRGLAAPSNLSMNQTLEGHSGSVQVVTWNEQYQKLTTSDENGLIIVWMLYKGSWIEEMINNRNKSVVRSMSWNADGQKICIVYEDGAVIVGSVDGNRIWGKDLKGIQLSHVTWSADSKVLLFGMANGEIHIYDNQGNFMIKMKLSCLVNVTGAISIAGIHWYHGTEGYVEPDCPCLAVCFDNGRCQIMRHENDQNPVLIDTGMYVVGIQWNHMGSVLAVAGFQKAAMQDKDVNIVQFYTPFGEHLGTLKVPGKEISALSWEGGGLKIALAVDSFIYFANIRPNYKWGYCSNTVVYAYTRPDRPEYCVVFWDTKNNEKYVKYVKGLISITTCGDFCILATKADENHPQFVLVLCNSIGTPLDPKYIDIVPLFVAMTKTHVIAASKEAFYTWQYRVAKKLTALEINQITRSRKEGRERIYHVDDTPSGSMDGVLDYSKTIQGTRDPICAITASDKILIVGRESGTIQRYSLPNVGLIQKYSLNCRAYQLSLNCNSSRLAIIDISGVLTFFDLDARVTDSTGQQVVGELLKLERRDVWDMKWAKDNPDLFAMMEKTRMYVFRNLDPEEPIQTSGYICNFEDLEIKSVLLDEILKDPEHPNKDYLINFEIRSLRDSRALIEKVGIKDASQFIEDNPHPRLWRLLAEAALQKLDLYTAEQAFVRCKDYQGIKFVKRLGKLLSESMKQAEVVGYFGRFEEAERTYLEMDRRDLAIGLRLKLGDWFRVLQLLKTGSGDADDSLLEQANNAIGDYFADRQKWLNAVQYYVQGRNQERLAECYYMLEDYEGLENLAISLPENHKLLPEIAQMFVRVGMCEQAVTAFLKCSQPKAAVDTCVHLNQWNKAVELAKNHSMKEIGSLLARYASHLLEKNKTLDAIELYRKANYFFDAAKLMFKIADEEAKKGSKPLRVKKLYVLSALLIEQYHEQMKNAQRGKVKGKSSEATSALAGLLEEEVLSTTDRFTDNAWRGAEAYHFFILAQRQLYEGCVDTALKTALHLKDYEDIIPPVEIYSLLALCACASRAFGTCSKAFIKLKSLETLSSEQKQQYEDLALEIFTKHTSKDNRKPELDSLMEGGEGKLPTCVATGSPITEYQFWMCSVCKHGVLAQEISHYSFCPLCHSPVG

SEQ ID NO: 816671 - protein, 1187 aa, Homo sapiens
CQGDGSFPELLVLPIGDVEPLLVEGLSGRRDPLGDPTMFFYLSKKISIPNNVKLQCVSWNKEQGFIACGGEDGLLKVLKLETQTDDAKLRGLAAPSNLSMNQTLEGHSGSVQVVTWNEQYQKLTTSDENGLIIVWMLYKGSWIEEMINNRNKSVVRSMSWNADGQKICIVYEDGAVIVGSVDGNRIWGKDLKGIQLSHVTWSADSKVLLFGMANGEIHIYDNQGNFMIKMKLSCLVNVTGAISIAGIHWYHGTEGYVEPDCPCLAVCFDNGRCQIMRHENDQNPVLIDTGMYVVGIQWNHMGSVLAVAGFQKAAMQDKDVNIVQFYTPFGEHLGTLKVPGKEISALSWEGGGLKIALAVDSFIYFANIRPNYKWGYCSNTVVYAYTRPDRPEYCVVFWDTKNNEKYVKYVKGLISITTCGDFCILATKADENHPQYHVFVAMTKTHVIAASKEAFYTWQYRVAKKLTALEINQITRSRKEGRERIYHVDDTPSGSMDGVLDYSKTIQGTRDPICAITASDKILIVGRESGTIQRYSLPNVGLIQKYSLNCRAYQLSLNCNSSRLAIIDISGVLTFFDLDARVTDSTGQQVVGELLKLERRDVWDMKWAKDNPDLFAMMEKTRMYVFRNLDPEEPIQTSGYICNFEDLEIKSVLLDEILKDPEHPNKDYLINFEIRSLRDSRALIEKVGIKDASQFIEDNPHPRLWRLLAEAALQKLDLYTAEQAFVRCKDYQGIKFVKRLGKLLSESMKQAEVVGYFGRFEEAERTYLEMDRRDLAIGLRLKLGDWFRVLQLLKTGSGDADDSLLEQANNAIGDYFADRQKWLNAVQYYVQGRNQERLAECYYMLEDYEGLENLAISLPENHKLLPEIAQMFVRVGMCEQAVTAFLKCSQPKAAVDTCVHLNQWNKAVELAKNHSMKEIGSLLARYASHLLEKNKTLDAIELYRKANYFFDAAKLMFKIADEEAKKGSKPLRVKKLYVLSALLIEQYHEQMKNAQRGKVKGKSSEATSALAGLLEEEVLSTTDRFTDNAWRGAEAYHFFILAQRQLYEGCVDTALKTALHLKDYEDIIPPVEIYSLLALCACASRAFGTCSKAFIKLKSLETLSSEQKQQYEDLALEIFTKHTSKDNRKPELDSLMEGGEGKLPTCVATGSPITEYQFWMCSVCKHGVLAQEISHYSFCPLCHSPVG

SEQ ID NO: 816672 - protein, 548 aa, Homo sapiens
LIDVFVLTSPPRMFKGLGFWDPEHPNKDYLINFEIRSLRDSRALIEKVGIKDASQFIEDNPHPRLWRLLAEAALQKLDLYTAEQAFVRCKDYQGIKFVKRLGKLLSESMKQAEVVGYFGRFEEAERTYLEMDRRDLAIGLRLKLGDWFRVLQLLKTGSGDADDSLLEQANNAIGDYFADRQKWLNAVQYYVQGRNQERLAECYYMLEDYEGLENLAISLPENHKLLPEIAQMFVRVGMCEQAVTAFLKCSQPKAAVDTCVHLNQWNKAVELAKNHSMKEIGSLLARYASHLLEKNKTLDAIELYRKANYFFDAAKLMFKIADEEAKKGSKPLRVKKLYVLSALLIEQYHEQMKNAQRGKVKGKSSEATSALAGLLEEEVLSTTDRFTDNAWRGAEAYHFFILAQRQLYEGCVDTALKTALHLKDYEDIIPPVEIYSLLALCACASRAFGTCSKAFIKLKSLETLSSEQKQQYEDLALEIFTKHTSKDNRKPELDSLMEGGEGKLPTCVATGSPITEYQFWMCSVCKHGVLAQEISHYSFCPLCHSPVG

SEQ ID NO: 816673 - protein, 439 aa, Homo sapiens
CQGDGSFPELLVLPIGDVEPLLVEGLSGRRDPLGDPTMFFYLSKKISIPNNVKLQCVSWNKEQGFIACGGEDGLLKVLKLETQTDDAKLRGLAAPSNLSMNQTLEGHSGSVQVVTWNEQYQKLTTSDENGLIIVWMLYKGSWIEEMINNRNKSVVRSMSWNADGQKICIVYEDGAVIVGSVDGNRIWGKDLKGIQLSHVTWSADSKVLLFGMANGEIHIYDNQGNFMIKMKLSCLVNVTGAISIAGIHWYHGTEGYVEPDCPCLAVCFDNGRCQIMRHENDQNPVLIDTGMYVVGIQWNHMGSVLAVAGFQKAAMQDKDVNIVQFYTPFGEHLGTLKVPGKEISALSWEGGGLKIALAVDSFIYFANIRPNYKWGYCSNTVVYAYTRPDRPEYCVVFWDTKNNEKYVKYVKGLISITTCGDFCILATKADENHPQVGVS

SEQ ID NO: 816674 - protein, 639 aa, Homo sapiens
CQGDGSFPELLVLPIGDVEPLLVEGLSGRRDPLGDPTMFFYLSKKISIPNNVKLQCVSWNKEQGFIACGGEDGLLKVLKLETQTDDAKLRGLAAPSNLSMNQTLEGHSGSVQVVTWNEQYQKLTTSDENGLIIVWMLYKGSWIEEMINNRNKSVVRSMSWNADGQKICIVYEDGAVIVGSVDGNRIWGKDLKGIQLSHVTWSADSKVLLFGMANGEIHIYDNQGNFMIKMKLSCLVNVTGAISIAGIHWYHGTEGYVEPDCPCLAVCFDNGRCQIMRHENDQNPVLIDTGMYVVGIQWNHMGSVLAVAGFQKAAMQDKDVNIVQFYTPFGEHLGTLKVPGKEISALSWEGGGLKIALAVDSFIYFANIRPNYKWGYCSNTVVYAYTRPDRPEYCVVFWDTKNNEKYVKYVKGLISITTCGDFCILATKADENHPQYHVFVAMTKTHVIAASKEAFYTWQYRVAKKLTALEINQITRSRKEGRERIYHVDDTPSGSMDGVLDYSKTIQGTRDPICAITASDKILIVGRESGTIQRYSLPNVGLIQKYSLNCRAYQLSLNCNSSRLAIIDISGVLTFFDLDARVTDSTGQQVVGELLKLERRDVWDMKWAKDNPDLFAMMEKTRMYVFRNLDPEVKTRNEC

SEQ ID NO: 816675 - protein, 200 aa, Homo sapiens
MAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATKYHTVPLPPKGRVLIHWMTLCQTQMKLMAIPLVFQIMFGILNGLYHYAVFEETLEKTIHEE

SEQ ID NO: 816676 - protein, 200 aa, Homo sapiens; identical to SEQ ID NO: 816675

SEQ ID NO: 816677 - protein, 200 aa, Homo sapiens; identical to SEQ ID NO: 816675

SEQ ID NO: 816678 - protein, 200 aa, Homo sapiens; identical to SEQ ID NO: 816675

SEQ ID NO: 816679 - protein, 230 aa, Homo sapiens
MVVFGYEAGTKPRDSGVVPVGTEEAPKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATKYHTVPLPPKGRVLIHWMTLCQTQMKLMAIPLVFQIMFGILNGLYHYAVFEETLEKTIHEE

SEQ ID NO: 816680 - protein, 230 aa, Homo sapiens; identical to SEQ ID NO: 816679

SEQ ID NO: 816681 - protein, 200 aa, Homo sapiens; identical to SEQ ID NO: 816675

SEQ ID NO: 816682 - protein, 200 aa, Homo sapiens; identical to SEQ ID NO: 816675

SEQ ID NO: 816683 - protein, 210 aa, Homo sapiens
MLNKILKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATKYHTVPLPPKGRVLIHWMTLCQTQMKLMAIPLVFQIMFGILNGLYHYAVFEETLEKTIHEE

SEQ ID NO: 816684 - protein, 200 aa, Homo sapiens; identical to SEQ ID NO: 816675

SEQ ID NO: 816685 - protein, 200 aa, Homo sapiens; identical to SEQ ID NO: 816675

SEQ ID NO: 816686 - protein, 203 aa, Homo sapiens
VSTQSGYYGRGRPKWWCSGMRLGLSQGIQVWCRWELRKRPRTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATKYHTVPLPPKGRVLIHWMTLCQTQMKLMAIPLVFQIMFGILNGLYHYAVFEETLEKTIHEE

SEQ ID NO: 816687 - protein, 185 aa, Homo sapiens
FRGSPFGVLLALMKKFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATKYHTVPLPPKGRVLIHWMTLCQTQMKLMAIPLVFQIMFGILNGLYHYAVFEETLEKTIHEE

SEQ ID NO: 816688 - protein, 164 aa, Homo sapiens
MAASMHGQPSPSLEDAKLRRPMVIEIIEKNFDYLRKEMTQNIYQMATFGTTAGFSGIFSNFLFRRCYNISKENCVFRSSLIGIVCGVFYPSSLAFTKNGRLATKYHTVPLPPKGRVLIHWMTLCQTQMKLMAIPLVFQIMFGILNGLYHYAVFEETLEKTIHEE

SEQ ID NO: 816689 - protein, 202 aa, Homo sapiens
INAEWLLRPGETKMVVFGYEAGTKPRDSGVVPVGTEEAPKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATKSSSFSFFFLFFSFLFFFFF

SEQ ID NO: 816690 - protein, 69 aa, Homo sapiens
INAEWLLRPGETKMVVFGYEAGTKPRDSGVVPVGTEEAPKDTKYISNGDIWNNSWFLWNILKLPVQTLL

SEQ ID NO: 816691 - protein, 110 aa, Homo sapiens
MAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSGEFKFTNV

SEQ ID NO: 816692 - protein, 71 aa, Homo sapiens
INAEWLLRPGETKMVVFGYEAGTKPRDSGVVPVGTEEAPKDTKYISNGDIWNNSWFLWNILKLPVQTLLQG

SEQ ID NO: 816693 - protein, 120 aa, Homo sapiens
MLNKILKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSGEFKFTNV

SEQ ID NO: 816694 - protein, 153 aa, Homo sapiens
INAEWLLRPGETKMVVFGYEAGTKPRDSGVVPVGTEEAPKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSGEFKFTNV

SEQ ID NO: 816695 - protein, 147 aa, Homo sapiens
MALKRIQKELSDLQRDPPAHCSAGPVGDDLFHWQATIMGPPDSAYQGGVFFLTVHFPTDYPFKPPKIAFTTKIYHPNINSNGSICLDILRSQWSPALTVSKVLLSICSLLCDPNPDDPLVPDIAQIYKSDKEKYNRHAREWTQKYAM

SEQ ID NO: 816696 - protein, 147 aa, Homo sapiens; identical to SEQ ID NO: 816695

SEQ ID NO: 816697 - protein, 133 aa, Homo sapiens
MALKRIQKELSDLQRDPPAHCSAGPVGDDLFHWQATIMGPPDSAYQGGVFFLTVHFPTDYPFKPPKIAFTTKIYHPNINSNGSICLDILRSQWSPALTVSKVLLSICSLLCDPNPDDPLVPDIAQIYKSDKEK

SEQ ID NO: 816698 - protein, 519 aa, Homo sapiens
AALRGGGRSRRGSSKMAAQRRSLLQSEQQPSWTDDLPLCHLSGVGSASNRSYSADGKGTESHPPEDSWLKFRSENNCFLYGVFNGYDGNRVTNFVAQRLSAELLLGQLNAEHAEADVRRVLLQAFDVVERSFLESIDDALAEKASLQSQLPEGVPQHQLPPQYQKILERLKTLEREISGGAMAVVAVLLNNKLYVANVGTNRALLCKSTVDGLQVTQLNVDHTTENEDELFRLSQLGLDAGKIKQVGIICGQESTRRIGDYKVKYGYTDIDLLSAAKSKPIIAEPEIHGAQPLDGVTGFLVLMSEGLYKALEAAHGPGQANQEIAAMIDTEFAKQTSLDAVAQAVVDRVKRIHSDTFASGGERARFCPRHEDMTLLVRNFGYPLGEMSQPTPSPAPAAGGRVYPVSVPYSSAQSTSKTSVTLSLVMPSQGQMVNGAHSASTLDEATPTLTNQSPTLTLQSTNTHTQSSSSSSDGGLFRSRPAHSLPPGEDGRVEPYVDFAEFYRLWSVDHGEQSVVTAP

SEQ ID NO: 816699 - protein, 519 aa, Homo sapiens; identical to SEQ ID NO: 816698

SEQ ID NO: 816700 - protein, 504 aa, Homo sapiens
MGSQRRSLLQSEQQPSWTDDLPLCHLSGVGSASNRSYSADGKGTESHPPEDSWLKFRSENNCFLYGVFNGYDGNRVTNFVAQRLSAELLLGQLNAEHAEADVRRVLLQAFDVVERSFLESIDDALAEKASLQSQLPEGVPQHQLPPQYQKILERLKTLEREISGGAMAVVAVLLNNKLYVANVGTNRALLCKSTVDGLQVTQLNVDHTTENEDELFRLSQLGLDAGKIKQVGIICGQESTRRIGDYKVKYGYTDIDLLSAAKSKPIIAEPEIHGAQPLDGVTGFLVLMSEGLYKALEAAHGPGQANQEIAAMIDTEFAKQTSLDAVAQAVVDRVKRIHSDTFASGGERARFCPRHEDMTLLVRNFGYPLGEMSQPTPSPAPAAGGRVYPVSVPYSSAQSTSKTSVTLSLVMPSQGQMVNGAHSASTLDEATPTLTNQSPTLTLQSTNTHTQSSSSSSDGGLFRSRPAHSLPPGEDGRVEPYVDFAEFYRLWSVDHGEQSVVTAP

SEQ ID NO: 816701 - protein, 325 aa, Homo sapiens
MSATGTNRALLCKSTVDGLQVTQLNVDHTTENEDELFRLSQLGLDAGKIKQVGIICGQESTRRIGDYKVKYGYTDIDLLSAAKSKPIIAEPEIHGAQPLDGVTGFLVLMSEGLYKALEAAHGPGQANQEIAAMIDTEFAKQTSLDAVAQAVVDRVKRIHSDTFASGGERARFCPRHEDMTLLVRNFGYPLGEMSQPTPSPAPAAGGRVYPVSVPYSSAQSTSKTSVTLSLVMPSQGQMVNGAHSASTLDEATPTLTNQSPTLTLQSTNTHTQSSSSSSDGGLFRSRPAHSLPPGEDGRVEPYVDFAEFYRLWSVDHGEQSVVTAP

SEQ ID NO: 816702 - protein, 519 aa, Homo sapiens; identical to SEQ ID NO: 816698

SEQ ID NO: 816703 - protein, 425 aa, Homo sapiens
AALRGGGRSRRGSSKMAAQRRSLLQSEQQPSWTDDLPLCHLSGVGSASNRSYSADGKGTESHPPEDSWLKFRSENNCFLYGVFNGYDGNRVTNFVAQRLSAELLLGQLNAEHAEADVRRVLLQAFDVVERSFLESIDDALAEKASLQSQLPEGVPQHQLPPQYQKILERLKTLEREISGGAMAVVAVLLNNKLYVANVGTNRALLCKSTVDGLQVTQLNVDHTTENEDELFRLSQLGLDAGKIKQVGIICGQESTRRIGDYKVKYGYTDIDLLSAAKSKPIIAEPEIHGAQPLDGVTGFLVLMSEGLYKALEAAHGPGQANQEIAAMIDTEFAKQTSLDAVAQAVVDRVKRIHSDTFASGGERARFCPRHEDMTLLVRNFGYPWAALTGSSTVGSHSRNGRKTGLSPGSSLTPSLPTLKPSLFCR

SEQ ID NO: 816704 - protein, 120 aa, Homo sapiens
GESSEAGEKEAAAEEDRLRVPGTAGPGRVGAAPRSLPGSSYPLPQEIAAMIDTEFAKQTSLDAVAQAVVDRVKRIHSDTFTHPGWRDTALRDGLMVARTSSLLRGWAGAEDGNWLVSTEI

SEQ ID NO: 816705 - protein, 560 aa, Homo sapiens
AALRGGGRSRRGSSKMAAQRRSLLQSEQQPSWTDDLPLCHLSGVGSASNRSYSADGKGTESHPPEDSWLKFRSENNCFLYGVFNGYDGNRVTNFVAQRLSAELLLGQLNAEHAEADVRRVLLQAFDVVERSFLESIDDALAEKASLQSQLPEGVPQHQLPPQYQKILERLKTLEREISGGAMAVVAVLLNNKLYVANVGTNRALLCKSTVDGLQVTQLNVDHTTENEDELFRLSQLGLDAGKIKQVGIICGQESTRRIGDYKVKYGYTDIDLLSAAKSKPIIAEPEIHGAQPLDGVTGFLVLMSEGLYKALEAAHGPGQANQMESCSVGQAGVQWCQSRLTVTSTSRVQVILLPQPPEWLGLQEIAAMIDTEFAKQTSLDAVAQAVVDRVKRIHSDTFASGGERARFCPRHEDMTLLVRNFGYPLGEMSQPTPSPAPAAGGRVYPVSVPYSSAQSTSKTSVTLSLVMPSQGQMVNGAHSASTLDEATPTLTNQSPTLTLQSTNTHTQSSSSSSDGGLFRSRPAHSLPPGEDGRVEPYVDFAEFYRLWSVDHGEQSVVTAP

SEQ ID NO: 816706 - protein, 338 aa, Homo sapiens
MAVVAVLLNNKLYVANVGTNRALLCKSTVDGLQVTQLNVDHTTENEDELFRLSQLGLDAGKIKQVGIICGQESTRRIGDYKVKYGYTDIDLLSAAKSKPIIAEPEIHGAQPLDGVTGFLVLMSEGLYKALEAAHGPGQANQEIAAMIDTEFAKQTSLDAVAQAVVDRVKRIHSDTFASGGERARFCPRHEDMTLLVRNFGYPLGEMSQPTPSPAPAAGGRVYPVSVPYSSAQSTSKTSVTLSLVMPSQGQMVNGAHSASTLDEATPTLTNQSPTLTLQSTNTHTQSSSSSSDGGLFRSRPAHSLPPGEDGRVEPYVDFAEFYRLWSVDHGEQSVVTAP

SEQ ID NO: 816707 - protein, 519 aa, Homo sapiens; identical to SEQ ID NO: 816698

SEQ ID NO: 816708 - protein, 108 aa, Homo sapiens
RHRPRHADGEPEMDCYMSQTWKSMIELNKHLPLEKSGDLSFCNLTAMFAIETFGLIPSPSVYLVASFLFVLMLLFFTILVLSYFRYMRIYRRYIYEPLHKPQRKRKKN

SEQ ID NO: 816709 - protein, 190 aa, Homo sapiens
FQPVVQLFDDNGYVKDVEANFIVWEIHGRDDYSFNNTMAQSGCLHEAQTWKSMIELNKHLPLEEVWGPENYKHCFSYAIGKPGDLNQPYEIINSSNGNHIFWPMGHSGMYVFRVKILDPNYSFCNLTAMFAIETFGLIPSPSVYLVASFLFVLMLLFFTILVLSYFRYMRIYRRYIYEPLHKPQRKRKKN

SEQ ID NO: 816710 - protein, 108 aa, Homo sapiens; identical to SEQ ID NO: 816708

SEQ ID NO: 816711 - protein, 91 aa, Homo sapiens
RHRPRHADGEPEMDCYMSQTWKSMIELNKHLPLEEVWGPESPSVYLVASFLFVLMLLFFTILVLSYFRYMRIYRRYIYEPLHKPQRKRKKN

SEQ ID NO: 816712 - protein, 69 aa, Homo sapiens
MNHFTNLKENCRQSRMEDHKQDEIPRALIKAAVHKELLMSPKSRIGQRYLLVIAVLKVLTSQEKNKINS

SEQ ID NO: 816713 - protein, 31 aa, Homo sapiens
MSPKSRIGQRYLLVIAVLKVLTSQEKNKINS

SEQ ID NO: 816714 - protein, 428 aa, Homo sapiens
MDPSVTLWQFLLQLLREQGNGHIISWTSRDGGEFKLVDAEEVARLWGLRKNKTNMNYDKLSRALRYYYDKNIIRKVSGQKFVYKFVSYPEVAGCSTEDCPPQPEVSVTSTMPNVAPAAIHAAPGDTVSGKPGTPKGAGMAGPGGLARSSRNEYMRSGLYSTFTIQSLQPQPPPHPRPAVVLPSAAPAGAAAPPSGSRSTSPSPLEACLEAEEAGLPLQVILTPPEAPNLKSEELNVEPGLGRALPPEVKVEGPKEELEVAGERGFVPETTKAEPEVPPQEGVPARLPAVVMDTAGQAGGHAASSPEISQPQKGRKPRDLELPLSPSLLGGPGPERTPGSGSGSGLQAPGPALTPSLLPTHTLTPVLLTPSSLPPSIHFWSTLSPIAPRSPAKLSFQFPSSGSAQVHIPSISVDGLSTPVVLSPGPQKP

SEQ ID NO: 816715 - protein, 428 aa, Homo sapiens; identical to SEQ ID NO: 816714

SEQ ID NO: 816716 - protein, 428 aa, Homo sapiens; identical to SEQ ID NO: 816714

SEQ ID NO: 816717 - protein, 428 aa, Homo sapiens; identical to SEQ ID NO: 816714

SEQ ID NO: 816718 - protein, 108 aa, Homo sapiens
TLGSSSSGPRPSCRETQGRLLGAAAATATTTSTAASEPRPGGRWGRVWSPRPPELPTLPTPPPRYTQPQLSGDPSVALFIPPFLYIVANQSVAPHSSASLFNSTPGMA

SEQ ID NO: 816719 - protein, 428 aa, Homo sapiens; identical to SEQ ID NO: 816714

SEQ ID NO: 816720 - protein, 388 aa, Homo sapiens
MDPSVTLWQFLLQLLREQGNGHIISWTSRDGGEFKLVDAEEVARLWGLRKNKTNMNYDKLSRALRYYYDKNIIRKVSGQKFVYKFVSYPEVAGCSTEDCPPQPEVSVTSTMPNVAPAAIHAAPGDTVSGKPGTPKGAGMAGPGGLARSSRNEYMRSGLYSTFTIQSLQPQPPPHPRPAVVLPSAAPAGAAAPPSGSRSTSPSPLEACLEAEEAGLPLQVILTPPEAPNLKSEELNVEPGLGRALPPEVKVEGPKEELEVAGERGFVPETTKAEPEVPPQEGVPARLPAVVMDTAGQAGGHAASSPEISQPQKGRKPRDLELPLSPSLLDKTIEVWLENDLSFFISQPALGEMREPCLRFWMFPPSQPPNFLKSPREWGIVPVNIYFSK

SEQ ID NO: 816721 - protein, 603 aa, Homo sapiens
SGPQSAYNGAAVSRTFCRRRRRRRPSSFFSRQIFVVWEGSRDGLELADPLLEQPRSEKAPQPRGGAAAAAPEAPPPAASVGPRPARPVAPRLPAESPRGSRCVWGQPTAGTMVKFPALTHYWPLIRFLVPLGITNIAIDFGEQALNRGIAAVKEDAVEMLASYGLAYSLMKFFTGPMSDFKNVGLVFVNSKRDRTKAVLCMVVAGAIAAVFHTLIAYSDLGYYIINKLHHVDESVGSKTRRAFLYLAAFPFMDAMAWTHAGILLKHKYSFLVGCASISDVIAQVVFVAILLHSHLECREPLLIPILSLYMGALVRCTTLCLGYYKNIHDIIPDRSGPELGGDATIRKMLSFWWPLALILATQRISRPIVNLFVSRDLGGSSAATEAVAILTATYPVGHMPYGWLTEIRAVYPAFDKNNPSNKLVSTSNTVTAAHIKKFTFVCMALSLTLCFVMFWTPNVSEKILIDIIGVDFAFAELCVVPLRIFSFFPVPVTVRAHLTGWLMTLKKTFVLAPSSVLRIIVLIASLVVLPYLGVHGATLGVGSLLAGFVGESTMVAIAACYVYRKQKKKMENESATEGEDSAMTDMPPTEEVTDIVEMREENE

SEQ ID NO: 816722 - protein, 603 aa, Homo sapiens; identical to SEQ ID NO: 816721

SEQ ID NO: 816723 - protein, 190 aa, Homo sapiens
RVGAQSQMSIAQVVFVAILLHSHLECREPLLIPILSLYMGALVRCTTLCLGYYKNIHDIIPDRSGPELGGDATIRKMLSFWWPLALILATQRISRPIVNLFVSRDLGGSSAATEAVAILTATYPVGHMPYGWLTEIRAVYPAFDKNNPSNKLVSTSNTVTAAHIKKFTFVCMALSLTALSPCGIPGPSVC

SEQ ID NO: 816724 - protein, 146 aa, Homo sapiens
RTWSLRSGSSQRPGEGGKGCGIHVLWEGGGPAPSSWFPSHIRLLAAALTKPADGERRWSQPSRGYTYFPGFWHRRLCLDLALTDKLPLCSHLQGARCDPGRGLPPGGLCGRIHHGRHRCVLCLPEAGETAAPGASSRVHPPGCRRT

SEQ ID NO: 816725 - protein, 603 aa, Homo sapiens; identical to SEQ ID NO: 816721

SEQ ID NO: 816726 - protein, 507 aa, Homo sapiens
MTLRIGDCFSVWPELEPKATKAQHLAYCCISPQPLGITNIAIDFGEQALNRGIAAVKEDAVEMLASYGLAYSLMKFFTGPMSDFKNVGLVFVNSKRDRTKAVLCMVVAGAIAAVFHTLIAYSDLGYYIINKLHHVDESVGSKTRRAFLYLAAFPFMDAMAWTHAGILLKHKYSFLVGCASISDVIAQVVFVAILLHSHLECREPLLIPILSLYMGALVRCTTLCLGYYKNIHDIIPDRSGPELGGDATIRKMLSFWWPLALILATQRISRPIVNLFVSRDLGGSSAATEAVAILTATYPVGHMPYGWLTEIRAVYPAFDKNNPSNKLVSTSNTVTAAHIKKFTFVCMALSLTLCFVMFWTPNVSEKILIDIIGVDFAFAELCVVPLRIFSFFPVPVTVRAHLTGWLMTLKKTFVLAPSSVLRIIVLIASLVVLPYLGVHGATLGVGSLLAGFVGESTMVAIAACYVYRKQKKKMENESATEGEDSAMTDMPPTEEVTDIVEMREENE

SEQ ID NO: 816727 - protein, 445 aa, Homo sapiens
MLASYGLAYSLMKFFTGPMSDFKNVGLVFVNSKRDRTKAVLCMVVAGAIAAVFHTLIAYSDLGYYIINKLHHVDESVGSKTRRAFLYLAAFPFMDAMAWTHAGILLKHKYSFLVGCASISDVIAQVVFVAILLHSHLECREPLLIPILSLYMGALVRCTTLCLGYYKNIHDIIPDRSGPELGGDATIRKMLSFWWPLALILATQRISRPIVNLFVSRDLGGSSAATEAVAILTATYPVGHMPYGWLTEIRAVYPAFDKNNPSNKLVSTSNTVTAAHIKKFTFVCMALSLTLCFVMFWTPNVSEKILIDIIGVDFAFAELCVVPLRIFSFFPVPVTVRAHLTGWLMTLKKTFVLAPSSVLRIIVLIASLVVLPYLGVHGATLGVGSLLAGFVGESTMVAIAACYVYRKQKKKMENESATEGEDSAMTDMPPTEEVTDIVEMREENE

SEQ ID NO: 816728 - protein, 332 aa, Homo sapiens
RVGAQSQMSIAQVVFVAILLHSHLECREPLLIPILSLYMGALVRCTTLCLGYYKNIHDIIPDRSGPELGGDATIRKMLSFWWPLALILATQRISRPIVNLFVSRDLGGSSAATEAVAILTATYPVGHMPYGWLTEIRAVYPAFDKNNPSNKLVSTSNTVTAAHIKKFTFVCMALSLTLCFVMFWTPNVSEKILIDIIGVDFAFAELCVVPLRIFSFFPVPVTVRAHLTGWLMTLKKTFVLAPSSVLRIIVLIASLVVLPYLGVHGATLGVGSLLAGFVGESTMVAIAACYVYRKQKKKMENESATEGEDSAMTDMPPTEEVTDIVEMREENE

SEQ ID NO: 816729 - protein, 603 aa, Homo sapiens; identical to SEQ ID NO: 816721

SEQ ID NO: 816730 - protein, 582 aa, Homo sapiens
SGPQSAYNGAAVSRTFCRRRRRRRPSSFFSRQIFVVWEGSRDGLELADPLLEQPRSEKAPQPRGGAAAAAPEAPPPAASVGPRPARPVAPRLPAESPRGSRCVWGQPTAGTMVKFPALTHYWPLIRFLVPLGITNIAIDFGEQALNRGIAAVKEDAVEMLASYGLAYSLMKFFTGPMSDFKNVGLVFVNSKRDRTKAVLCMVVAGAIAAVFHTLIAYSDLGYYIINKLHHVDESVGSKTRRAFLYLAAFPFMDAMAWTHAGILLKHKYSFLVGCASISDVIAQVVFVAILLHSHLECREPLLIPILSLYMGALVRCTTLCLGYYKNIHDIIPDRSGPELGGDATIRKMLSFWWPLALILATQRISRPIVNLFVSRDLGGSSAATEAVAILTATYPVGHMPYGWLTEIRAVYPAFDKNNPSNKLVSTSNTVTAAHIKKFTFVCMALSLTLCFVMFWTPNVSEKILIDIIGVDFAFAELCVVPLRIFSFFPVPVTVRAHLTGWLMTLKKTFVLAPSSVLRIIVLIASLVVLPYLGVHGATLGVGSLLAGFVGESTMVAIAACYVYRKQKKMMDNDLSTGGENFA

SEQ ID NO: 816731 - protein, 222 aa, Homo sapiens
SGPQSAYNGAAVSRTFCRRRRRRRPSSFFSRQIFVVWEGSRDGLELADPLLEQPRSEKAPQPRGGAAAAAPEAPPPAASVGPRPARPVAPRLPAESPRGSRCVWGQPTAGTMVKFPALTHYWPLIRFLVPLGITNIAIDFGEQALNRGIAAVKEDAVEMLASYGLAYSLMKFFTGPMSDFKNVGLVFVNSKRDRTKAVLCMVVAGAIAAVFHTLIGEAADRH

SEQ ID NO: 816732 - protein, 461 aa, Homo sapiens
SGPQSAYNGAAVSRTFCRRRRRRRPSSFFSRQIFVVWEGSRDGLELADPLLEQPRSEKAPQPRGGAAAAAPEAPPPAASVGPRPARPVAPRLPAESPRGSRCVWGQPTAGTMVKFPALTHYWPLIRFLVPLGITNIAIDFGEQALNRGIAAVKEDAVEMLASYGLAYSLMKFFTGPMSDFKNVGLVFVNSKRDRTKAVLCMVVAGAIAAVFHTLIAYSDLGYYIINKLHHVDESVGSKTRRAFLYLAAFPFMDAMAWTHAGILLKHKYSFLVGCASISDVIAQVVFVAILLHSHLECREPLLIPILSLYMGALVRCTTLCLGYYKNIHDIIPDRSGPELGGDATIRKMLSFWWPLALILATQRISRPIVNLFVSRDLGGSSAATEAVAILTATYPVGHMPYGWLTEIRAVYPAFDKNNPSNKLVSTSNTVTAAHIKKFTFVCMALSLTALSPCGIPGPSVC

SEQ ID NO: 816733 - protein, 480 aa, Homo sapiens
SGPQSAYNGAAVSRTFCRRRRRRRPSSFFSRQIFVVWEGSRDGLELADPLLEQPRSEKAPQPRGGAAAAAPEAPPPAASVGPRPARPVAPRLPAESPRGSRCVWGQPTAGTMVKFPALTHYWPLIRFLVPLGITNIAIDFGEQALNRGIAAVKEDAVEMLASYGLAYSLMKFFTGPMSDFKNVGLVFVNSKRDRTKAVLCMVVAGAIAAVFHTLIAYSDLGYYIINKLHHVDESVGSKTRRAFLYLAAFPFMDAMAWTHAGILLKHKYSFLVGCASISDVIAQVVFVAILLHSHLECREPLLIPILSLYMGALVRCTTLCLGYYKNIHDIIPDRSGPELGGDATIRKMLSFWWPLALILATQRISRPIVNLFVSRDLGGSSAATEAVAILTATYPVGHMPYGWLTEIRAVYPAFDKNNPSNKLVSTSNTVTAAHIKKFTFVCMALSLTVRTEALSASSLCLVFVKGQVAILKGEILFSTM

SEQ ID NO: 816734 - protein, 271 aa, Homo sapiens
SGPQSAYNGAAVSRTFCRRRRRRRPSSFFSRQIFVVWEGSRDGLELADPLLEQPRSEKAPQPRGGAAAAAPEAPPPAASVGPRPARPVAPRLPAESPRGSRCVWGQPTAGTMVKFPALTHYWPLIRFLVPLGITNIAIDFGEQALNRGIAAVKEDAVEMLASYGLAYSLMKFFTGPMSDFKNVGLVFVNSKRDRTKAVLCMVVAGAIAAVFHTLIAYSDLGYYIINKLHHVDESVGSKTRRAFLYLAAFPFMDAMVSREDRWLSFFFFNWW

SEQ ID NO: 816735 - protein, 293 aa, Homo sapiens
LPGATGRLHTRCARRRPHARPMSSAPRSPTPRPRRMKKDESFLGKLGGTLARKRRAREVSDLQEEGKNAINSPMSPALADVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRWWSAFSSPQIQMLISFGNTLTDTPRNHALHPSIQSS

SEQ ID NO: 816736 - protein, 385 aa, Homo sapiens
LPGATGRLHTRCARRRPHARPMSSAPRSPTPRPRRMKKDESFLGKLGGTLARKRRAREVSDLQEEGKNAINSPMSPALADVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 816737 - protein, 270 aa, Homo sapiens
MPRLKCSGAVIAHCSLELLASSDPSASASQGARTTVSDLQEEGKNAINSPMSPALADVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRWWSAFSSPQIQMLISFGNTLTDTPRNHALHPSIQSS

SEQ ID NO: 816738 - protein, 185 aa, Homo sapiens
LPGATGRLHTRCARRRPHARPMSSAPRSPTPRPRRMKKDESFLGKLGGTLARKRRAREVSDLQEEGKNAINSPMSPALADVHPEDTQLEENEERTMIDPTSKEDPKFKELVKVRSSVLVGIFLLGRGLGFGVQGSHGQRELNPGLLKGMLVLHEKVGRHVGRGGRQRGSSPKCQAPPMCPARLGL

SEQ ID NO: 816739 - protein, 397 aa, Homo sapiens
MHHVFKDHQRGEKRGFLSPENKNCRRLELRRGCSCSWGLCSQALMASLAGSLLPGSDRSGVETSEYAQGGVSDLQEEGKNAINSPMSPALADVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 816740 - protein, 477 aa, Homo sapiens
LPGATGRLHTRCARRRPHARPMSSAPRSPTPRPRRMKKDESFLGKLGGTLARKRRAREVSDLQEEGKNAINSPMSPALADVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKVHNVSFAFELMLDGGLKKPKARPEGLKHRVIPWLLLDHRESGLQGPRAVTWSRPILQMKALSPKSRKSLRGHRASEMNKVSDSQEGSCPHKESGPRLPGPQRELSGPLSVTGVFGPDVVNLDLKSTLRVLYNLFTKYKNVE

SEQ ID NO: 816741 - protein, 385 aa, Homo sapiens; identical to SEQ ID NO: 816736

SEQ ID NO: 816742 - protein, 370 aa, Homo sapiens
LPGATGRLHTRCARRRPHARPMSSAPRSPTPRPRRMKKDESFLGKLGGTLARKRRAREVSDLQEEGKNAINSPMSPALADVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKFADGVYLVLLMGLLEDYFVPLHHFYLSPESFDQK

SEQ ID NO: 816743 - protein, 109 aa, Homo sapiens
MAAFGSQGVRTPRASSVTWSRPILQMKALSPKSRKSLRGHRASEMNKVSDSQEGSCPHKESGPRLPGPQRELSGPLSVTGVFGPDVVNLDLKSTLRVLYNLFTKYKNVE

SEQ ID NO: 816744 - protein, 257 aa, Homo sapiens
LPGATGRLHTRCARRRPHARPMSSAPRSPTPRPRRMKKDESFLGKLGGTLARKRRAREVSDLQEEGKNAINSPMSPALADVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGR

SEQ ID NO: 816745 - protein, 117 aa, Homo sapiens
MHHVFKDHQRGEKRGFLSPENKNCRRLELRRGCSCSWGLCSQALMASLAGSLLPGSDRSGVETSEYAQGGGKFWGKNCQKVDEGWVQWLMPVTLALWEAEEGGLLLEPRNLRLLCTT

SEQ ID NO: 816746 - protein, 141 aa, Homo sapiens
MGELAAPVNCFPPCKLAVGGMHRGVSQRRCESELQTQNLFPLHPSALHNGSLPALPQLCAPVHYQYTQELDRQTERKTQSASCRGLMGDSSLCLGMSVTGRREKNMAPSKASASGHSGQFPLYVEGNWPVRWQGWPWWAQC

SEQ ID NO: 816747 - protein, 1011 aa, Homo sapiens
MAQSNMFTVADVLSQDELRKKLYQTFKDRGILDTLKTQLRNQLIHELMHPVLSGELQPRSISVEGSSLLIGASNSLVADHLQRCGYEYSLSVFFPESGLAKEKVFTMQDLLQLIKINPTSSLYKSLVSGSDKENQKGFLMHFLKELAEYHQAKESCNMETQTSSTFNRDSLAEKLQLIDDQFADAYPQRIKFESLEIKLNEYKREIEEQLRAEMCQKLKFFKDTEIAKIKMEAKKKYEKELTMFQNDFEKACQAKSEALVLREKSTLERIHKHQEIETKEIYAQRQLLLKDMDLLRGREAELKQRVEAFELNQKLQEEKHKSITEALRRQEQNIKSFEETYDRKLKNELLKYQLELKDDYIIRTNRLIEDERKNKEKAVHLQEELIAINSKKEELNQSVNRVKELELELESVKAQSLAITKQNHMLNEKVKEMSDYSLLKEEKLELLAQNKLLKQQLEESRNENLRLLNRLAQPAPELAVFQKELRKAEKAIVVEHEEFESCRQALHKQLQDEIEHSAQLKAQILGYKASVKSLTTQVADLKLQLKQTQTALENEVYCNPKQSVIDRSVNGLINGNVVPCNGEISGDFLNNPFKQENVLARMVASRITNYPTAWVEGSSPDSDLEFVANTKARVKELQQEAERLEKAFRSYHRRVIKNSAKSPLAAKSPPSLHLLEAFKNITSSSPERHIFGEDRVVSEQPQVGTLEERNDVVEALTGSAASRLRGGTSSRRLSSTPLPKAKRSLESEMYLEGLGRSHIASPSPCPDRMPLPSPTESRHSLSIPPVSSPPEQKVGLYRRQTELQDKSEFSDVDKLAFKDNEEFESSFESAGNMPRQLEMGGLSPAGDMSHVDAAAAAVPLSYQHPSVDQKQIEEQKEEEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 816748 - protein, 366 aa, Homo sapiens
MAQSNMFTVADVLSQDELRKKLYQTFKDRGILDTLKTQLRNQLIHELMHPVLSGELQPRSISVEGSSLLIGASNSLVADHLQRCGYEYSLSVFFPESGLAKEKVFTMQDLLQLIKINPTSSLYKSLVSGSDKENQKGFLMHFLKELAEYHQAKESCNMETQTSSTFNRDSLAEKLQLIDDQFADAYPQRIKFESLEIKLNEYKREIEEQLRAEMCQKLKFFKDTEIAKIKMEAKKKYEKELTMFQNDFEKACQAKSEALVLREKSTLERIHKHQEIETKEIYAQRQLLLKDMDLLRGREAELKQRVEAFELNQKLQEEKHKSITEALRRQEQNIKSFEETYDRKLKNELLNFHRLHGVCLALGILI

SEQ ID NO: 816749 - protein, 156 aa, Homo sapiens
LSLATPRSTAKLLSVLAPVFTELAPKGFCLPQERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 816750 - protein, 203 aa, Homo sapiens
NQKSNNCHYAIKAWELMERRFGGACIAQLGKGIGCKAFKLVPQGFPVTPCNAGSEWYPLTIGEWGTGPPFEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 816751 - protein, 366 aa, Homo sapiens; identical to SEQ ID NO: 816748

SEQ ID NO: 816752 - protein, 366 aa, Homo sapiens; identical to SEQ ID NO: 816748

SEQ ID NO: 816753 - protein, 587 aa, Homo sapiens
MLNEKVKEMSDYSLLKEEKLELLAQNKLLKQQLEESRNENLRLLNRLAQPAPELAVFQKELRKAEKAIVVEHEEFESCRQALHKQLQDEIEHSAQLKAQILGYKASVKSLTTQVADLKLQLKQTQTALENEVYCNPKQSVIDRSVNGLINGNVVPCNGEISGDFLNNPFKQENVLARMVASRITNYPTAWVEGSSPDSDLEFVANTKARVKELQQEAERLEKAFRSYHRRVIKNSAKSPLAAKSPPSLHLLEAFKNITSSSPERHIFGEDRVVSEQPQVGTLEERNDVVEALTGSAASRLRGGTSSRRLSSTPLPKAKRSLESEMYLEGLGRSHIASPSPCPDRMPLPSPTESRHSLSIPPVSSPPEQKVGLYRRQTELQDKSEFSDVDKLAFKDNEEFESSFESAGNMPRQLEMGGLSPAGDMSHVDAAAAAVPLSYQHPSVDQKQIEEQKEEEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 816754 - protein, 587 aa, Homo sapiens; identical to SEQ ID NO: 816753

SEQ ID NO: 816755 - protein, 366 aa, Homo sapiens; identical to SEQ ID NO: 816748

SEQ ID NO: 816756 - protein, 366 aa, Homo sapiens; identical to SEQ ID NO: 816748

SEQ ID NO: 816757 - protein, 366 aa, Homo sapiens; identical to SEQ ID NO: 816748

SEQ ID NO: 816758 - protein, 366 aa, Homo sapiens; identical to SEQ ID NO: 816748

SEQ ID NO: 816759 - protein, 366 aa, Homo sapiens; identical to SEQ ID NO: 816748

SEQ ID NO: 816760 - protein, 587 aa, Homo sapiens; identical to SEQ ID NO: 816753

SEQ ID NO: 816761 - protein, 587 aa, Homo sapiens; identical to SEQ ID NO: 816753

SEQ ID NO: 816762 - protein, 348 aa, Homo sapiens
LEDPQKPSLHLLEAFKNITSSSPERHIFGEDRVVSEQPQVGTLEERNDVVEALTGSAASRLRGGTSSRRLSSTPLPKAKRSLESEMYLEGLGRSHIASPSPCPDRMPLPSPTESRHSLSIPPVSSPPEQKVGLYRRQTELQDKSEFSDVDKLAFKDNEEFESSFESAGNMPRQLEMGGLSPAGDMSHVDAAAAAVPLSYQHPSVDQKQIEEQKEEEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 816763 - protein, 179 aa, Homo sapiens [sequence omitted]

SEQ ID NO: 816764 - protein, 293 aa, Homo sapiens
MAQNLRDAGPVPCSSKGLDHPLLQGCVSLDKLLPFSGPLFPASTGCAVLEELMLRLNFVVLASAPPYLSSPPEQKVGLYRRQTELQDKSEFSDVDKLAFKDNEEFESSFESAGNMPRQLEMGGLSPAGDMSHVDAAAAAVPLSYQHPSVDQKQIEEQKEEEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 816765 - protein, 366 aa, Homo sapiens; identical to SEQ ID NO: 816748

SEQ ID NO: 816766 - protein, 203 aa, Homo sapiens; identical to SEQ ID NO: 816750

SEQ ID NO: 816767 - protein, 284 aa, Homo sapiens
MAQSNMFTVADVLSQDELRKKLYQTFKDRGILDTLKTQLRNQLIHELMHPVLSGELQPRSISVEGSSLLIGASNSLVADHLQRCGYEYSLSVFFPESGLAKEKVFTMQDLLQLIKINPTSSLYKSLVSGSDKENQKGFLMHFLKELAEYHQAKESCNMETQTSSTFNRDSLAEKLQLIDDQFADAYPQRIKFESLEIKLNEYKREIEEQLRAEMCQKLKFFKDTEIAKIKMEAKQNLKLSFFGKRVPLKEFTSTKRWYLQIFYGWLFPAAISRLARDPATGWYS

SEQ ID NO: 816768 - protein, 155 aa, Homo sapiens
MAQSNMFTVADVLSQDELRKKLYQTFKDRGILDTLKTQLRNQLIHELMHPVLSGELQPRSISVEGSSLLIGASNSLVADHLQRCGYEYSLSVFFPESGLAKEKVFTMQDLLQLIKINPTSSLYKSLVSGSDKENQKGRSRHLCREQQQFSMYFFL

SEQ ID NO: 816769 - protein, 142 aa, Homo sapiens
MAQSNMFTVADVLSQDELRKKLYQTFKDRGILDTLKTQLRNQLIHELMHPVLSGELQPRSISVEGSSLLIGASNSLVADHLQRCGYEYSLSVFFPESGLAKEKVFTMQDLLQLIKINPTSSLYKSLVRWLSFCNLLWFVNYN

SEQ ID NO: 816770 - protein, 219 aa, Homo sapiens
PLPPCLSLSPSPSSSRLAAAPWRSPSLSGRLTERCELWETATPPPARDLPLGPAPCPTLPSARGSAKAPRTHRRLKSGDAHALAAPPNSLPPHPAPPPPPPPPPPPPPPPPPPPAAAAAGPTLPPTPPSVGSGCGSSLDYYFIYFGSCTSLSACSPRLLGPRAPPPLAPEPQTPATLDSTTPDPCQLPRVSAAGILLAAVFLEGSGFPTFLFPAQERIS

SEQ ID NO: 816771 - protein, 219 aa, Homo sapiens; identical to SEQ ID NO: 816770

SEQ ID NO: 816772 - protein, 354 aa, Homo sapiens
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFGEKIKKSPLTICFPEYTGPNTYEDAAAYIQAQFESKNRSPNKEIYCHMTCATDTNNIQVVFDAVTDIIIANNLRGCGLY

SEQ ID NO: 816773 - protein, 354 aa, Homo sapiens; identical to SEQ ID NO: 816772

SEQ ID NO: 816774 - protein, 271 aa, Homo sapiens
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTAPIPMKTQPPTSKHNLKAKTAHPTKKYIVT

SEQ ID NO: 816775 - protein, 354 aa, Homo sapiens; identical to SEQ ID NO: 816772

SEQ ID NO: 816776 - protein, 354 aa, Homo sapiens; identical to SEQ ID NO: 816772

SEQ ID NO: 816777 - protein, 250 aa, Homo sapiens
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTDTTCTGTNP

SEQ ID NO: 816778 - protein, 104 aa, Homo sapiens
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKVGP

SEQ ID NO: 816779 - protein, 90 aa, Homo sapiens
FFLLLKPLLLVLFVLHLFLLLPWIHPEIDNPEYSPDPSIYAYDNFGVLGLDLWQVKSGTIFDNFLITNDEAYAEEFGNETWGVTKQQRNK

SEQ ID NO: 816780 - protein, 116 aa, Homo sapiens
MIAQIISVRTVTNQRRSRFNPGPPVIQNPEYKGEWKPRQIDNPDYKGTWIHPEIDNPEYSPDPSIYAYDNFGVLGLDLWQVKSGTIFDNFLITNDEAYAEEFGNETWGVTKQQRNK

SEQ ID NO: 816781 - protein, 206 aa, Homo sapiens
MLQNRKTGMSGPRSMIPQTPSLRTGTSPSISLYPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 816782 - protein, 206 aa, Homo sapiens; identical to SEQ ID NO: 816781

SEQ ID NO: 816783 - protein, 206 aa, Homo sapiens; identical to SEQ ID NO: 816781

SEQ ID NO: 816784 - protein, 247 aa, Homo sapiens
MYPFLIREDYLRILWLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPVP

SEQ ID NO: 816785 - protein, 206 aa, Homo sapiens; identical to SEQ ID NO: 816781

SEQ ID NO: 816786 - protein, 206 aa, Homo sapiens; identical to SEQ ID NO: 816781

SEQ ID NO: 816787 - protein, 206 aa, Homo sapiens; identical to SEQ ID NO: 816781

SEQ ID NO: 816788 - protein, 206 aa, Homo sapiens; identical to SEQ ID NO: 816781

SEQ ID NO: 816789 - protein, 206 aa, Homo sapiens; identical to SEQ ID NO: 816781

SEQ ID NO: 816790 - protein, 247 aa, Homo sapiens; identical to SEQ ID NO: 816784

SEQ ID NO: 816791 - protein, 206 aa, Homo sapiens; identical to SEQ ID NO: 816781

SEQ ID NO: 816792 - protein, 206 aa, Homo sapiens; identical to SEQ ID NO: 816781

SEQ ID NO: 816793 - protein, 247 aa, Homo sapiens; identical to SEQ ID NO: 816784

SEQ ID NO: 816794 - protein, 206 aa, Homo sapiens; identical to SEQ ID NO: 816781

SEQ ID NO: 816795 - protein, 206 aa, Homo sapiens; identical to SEQ ID NO: 816781

SEQ ID NO: 816796 - protein, 206 aa, Homo sapiens; identical to SEQ ID NO: 816781

SEQ ID NO: 816797 - protein, 206 aa, Homo sapiens; identical to SEQ ID NO: 816781

SEQ ID NO: 816798 - protein, 206 aa, Homo sapiens; identical to SEQ ID NO: 816781

SEQ ID NO: 816799 - protein, 206 aa, Homo sapiens; identical to SEQ ID NO: 816781

SEQ ID NO: 816800 - protein, 206 aa, Homo sapiens; identical to SEQ ID NO: 816781

SEQ ID NO: 816801 - protein, 206 aa, Homo sapiens; identical to SEQ ID NO: 816781

SEQ ID NO: 816802 - protein, 247 aa, Homo sapiens; identical to SEQ ID NO: 816784

SEQ ID NO: 816803 - protein, 206 aa, Homo sapiens; identical to SEQ ID NO: 816781

SEQ ID NO: 816804 - protein, 247 aa, Homo sapiens; identical to SEQ ID NO: 816784

SEQ ID NO: 816805 - protein, 237 aa, Homo sapiens
MLQNRKTGMSGPRSMIPQTPSLRTGTSPSISLYPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKAAEGGGVSNPPSTEEERGSSHFTPPFLPCPQDWATSGWGSGSQIGSH

SEQ ID NO: 816806 - protein, 206 aa, Homo sapiens; identical to SEQ ID NO: 816781

SEQ ID NO: 816807 - protein, 247 aa, Homo sapiens; identical to SEQ ID NO: 816784

SEQ ID NO: 816808 - protein, 247 aa, Homo sapiens; identical to SEQ ID NO: 816784

SEQ ID NO: 816809 - protein, 206 aa, Homo sapiens; identical to SEQ ID NO: 816781

SEQ ID NO: 816810 - protein, 247 aa, Homo sapiens; identical to SEQ ID NO: 816784

SEQ ID NO: 816811 - protein, 247 aa, Homo sapiens; identical to SEQ ID NO: 816784

SEQ ID NO: 816812 - protein, 247 aa, Homo sapiens; identical to SEQ ID NO: 816784

SEQ ID NO: 816813 - protein, 247 aa, Homo sapiens; identical to SEQ ID NO: 816784

SEQ ID NO: 816814 - protein, 247 aa, Homo sapiens; identical to SEQ ID NO: 816784

SEQ ID NO: 816815 - protein, 247 aa, Homo sapiens; identical to SEQ ID NO: 816784

SEQ ID NO: 816816 - protein, 247 aa, Homo sapiens; identical to SEQ ID NO: 816784

SEQ ID NO: 816817 - protein, 247 aa, Homo sapiens; identical to SEQ ID NO: 816784

SEQ ID NO: 816818 - protein, 144 aa, Homo sapiens
MTSLRILWLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFDPLPALFFFFFKLVFYL

SEQ ID NO: 816819 - protein, 557 aa, Homo sapiens
MYPFLIREDYLRILWLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASNGDGYGQIVPKSLVGASSLRETAVNGGPGLMRPDDTATAPLFRAPFGSSLAQRTTRREHAKSKNDKRTTNKEDETRVTRNEDKHRRETQHRAREKQQEAEDEDEEGREQADKNRGKKLNKNRQKEEDDKQGKNENTETKTSEQNEENNDKETQDKRKKKEKRKAKQENTRETKQTETDRSRAKRSEKRVSMTEEKQRREEQSEEKEEKYEKAEAREQTKSREERSEMAQRRRQQERGRSDDRKRKTEEEGGNNRKKQNRDKEEREEQDNTRTKNREKKIAENKREKERKERPRKKKKEEKEGKERKKERKKERQQQQEKQQKKKRRRKREKEKNRNKKTNG

SEQ ID NO: 816820 - protein, 201 aa, Homo sapiens
MYPFLIREDYLRILWLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDD

SEQ ID NO: 816821 - protein, 207 aa, Homo sapiens
MYPFLIREDYLRILWLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKVCLGVVANGCHGEIQRSASLGGGPRSPSSFFRMMSLHTCTH

SEQ ID NO: 816822 - protein, 87 aa, Homo sapiens
LKRILGSVILGSFEPFSNKGQTLVVQFTVKHEQNIDCGGGYVKLFPNSLDQTDMLYSESPCMSVWSKLLGNSFMHGDSEYNIMFVIS

SEQ ID NO: 816823 - protein, 139 aa, Homo sapiens
MASQSQGIQQLLQAEKRAAEKVSEARKRKNRRLKQAKEEAQAEIEQYRLQREKEFKAKEAAALGSRGSCSTEVEKETQEKMTILQTYFRQNRDEVLDNLLAFVCDIRPEIHENYRINGYEERSTCAVEWHFRCPHEYEA

SEQ ID NO: 816824 - protein, 139 aa, Homo sapiens; identical to SEQ ID NO: 816823

SEQ ID NO: 816825 - protein, 139 aa, Homo sapiens; identical to SEQ ID NO: 816823

SEQ ID NO: 816826 - protein, 139 aa, Homo sapiens; identical to SEQ ID NO: 816823

SEQ ID NO: 816827 - protein, 139 aa, Homo sapiens; identical to SEQ ID NO: 816823

SEQ ID NO: 816828 - protein, 139 aa, Homo sapiens; identical to SEQ ID NO: 816823

SEQ ID NO: 816829 - protein, 139 aa, Homo sapiens; identical to SEQ ID NO: 816823

SEQ ID NO: 816830 - protein, 139 aa, Homo sapiens; identical to SEQ ID NO: 816823

SEQ ID NO: 816831 - protein, 115 aa, Homo sapiens
MLDGKNRRLKQAKEEAQAEIEQYRLQREKEFKAKEAAALGSRGSCSTEVEKETQEKMTILQTYFRQNRDEVLDNLLAFVCDIRPEIHENYRINGYEERSTCAVEWHFRCPHEYEA

SEQ ID NO: 816832 - protein, 139 aa, Homo sapiens; identical to SEQ ID NO: 816823

SEQ ID NO: 816833 - protein, 123 aa, Homo sapiens
MASQSQGIQQLLQAEKRAAEKVSEARKRKNRRLKQAKEEAQAEIEQYRLQREKEFKAKEAAALGSRGSCSTEVEKETQEKMTILQTYFRQNRDEVLDNLLAFVCDIRPEIHEWHFRCPHEYEA

SEQ ID NO: 816834 - protein, 139 aa, Homo sapiens; identical to SEQ ID NO: 816823

SEQ ID NO: 816835 - protein, 145 aa, Homo sapiens
MASQSQGIQQLLQAEKRAAEKVSEARKRKNRRLKQAKEEAQAEIEQYRLQREKEFKAKEAAALGSRGSCSTEVEKETQEKMTILQTYFRHRLRPLRRPQGLEGICLPTPSPVGLGLCPLRGRQAGLGRGPLGLLLHGQQGVRTAL

SEQ ID NO: 816836 - protein, 98 aa, Homo sapiens
MASQSQGIQQLLQAEKRAAEKVSEARKRKNRRLKQAKEEAQAEIEQYRLQREKEFKAKEAAHWDPVAVREQHESEQIELTHHVRTTDTLGPDIFFGRR

SEQ ID NO: 816837 - protein, 132 aa, Homo sapiens
MSTVSYVSFRFSETEERCLTSSSSASSPASHLLCAPRQSAQSHVHPRSALSLTCLLLVHLSIAHLHHARINALLCNHTHPASRSIHPRASNITRIHQDHETTRSSGSSYSQDSIIFPSAVVGGCIFPNLCLA

SEQ ID NO: 816838 - protein, 748 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 816839 - protein, 306 aa, Homo sapiens
MKCTPRGPDSELEMLCLLRVSAKASGPQRKTPILVLLGKKKKDNFKLWDEMSTKQVGEFPVNLRPQGRVPSAPFSFPQIAKGSYCPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVVSMFFIYKENLKWFDLNFTWPEVIKVTRKQLNYLY

SEQ ID NO: 816840 - protein, 799 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDISERLKLRLRKLMSLELWTSCSLPCALLLHSWKKAVNSHCLYFKDFWGFSEIYYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 816841 - protein, 799 aa, Homo sapiens; identical to SEQ ID NO: 816840

SEQ ID NO: 816842 - protein, 568 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGVSI

SEQ ID NO: 816843 - protein, 799 aa, Homo sapiens; identical to SEQ ID NO: 816840

SEQ ID NO: 816844 - protein, 152 aa, Homo sapiens
MYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGVSI

SEQ ID NO: 816845 - protein, 677 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAL

SEQ ID NO: 816846 - protein, 218 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQTLLLAPASSMSCACSPFTFCPCL

SEQ ID NO: 816847 - protein, 342 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSLSY

SEQ ID NO: 816848 - protein, 493 aa, Homo sapiens
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVGRDPAAAPALWRRRGTAPPLSAIVSQVQSEIRRGWHHCRLRRSLGEEQRQLPERAFRALPSGSGPGEVPTSRGLSSGTLPGPGNEASRELESYC

SEQ ID NO: 816849 - protein, 466 aa, Homo sapiens
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 816850 - protein, 112 aa, Homo sapiens
MKPSSTFIVTIRKTGKDLNLLTKVWNNNENRNPNLNTLLTCKMYLSINLPNWFQACTSGIIFWWNVGFWLVVEHLLFLKTEVRTQTEPPVGSPFLLPRQSRFIKTGIAMEKE

SEQ ID NO: 816851 - protein, 254 aa, Homo sapiens
MFKKPLLGRVRWLMPVKPALWEAEAGGSRGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQGMEQQREPKPKSKYTSYM

SEQ ID NO: 816852 - protein, 3603 aa, Homo sapiens
PSCPARPALVPGPGPASPGLRARSSSALQWLGTRCYEREASRAPRPSGGVGCAAGLGTGLSLRLALPSGDYLAPLIALPSSEEPSVSRACGVSADMTAWRRFQSLLLLLGLLVLCARLLTAAKGQNCGGLVQGPNGTIESPGFPHGYPNYANCTWIIITGERNRIQLSFHTFALEENFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSHMCLDPGIPENGRRAGSDFSRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDNGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKMTFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNTHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQDPSDQFCHGAELGLPFEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPMCKPVACPSIEAQLSEHVIWRLVSGSLNEYGAQVLLSCSPGYYLEGWRLLRCQANGTWNIGDERPSCRAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFHLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 816853 - protein, 3484 aa, Homo sapiens
PSCPARPALVPGPGPASPGLRARSSSALQWLGTRCYEREASRAPRPSGGVGCAAGLGTGLSLRLALPSGDYLAPLIALPSSEEPSVSRACGVSADMTAWRRFQSLLLLLGLLVLCARLLTAAKGQNCGGLVQGPNGTIESPGFPHGYPNYANCTWIIITGERNRIQLSFHTFALEENFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSHMCLDPGIPENGRRAGSDFSRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDNGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKMTFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNTHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQDPSDQFCHGAELGLPFEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPMCKPVACPSIEAQLSEHVIWRLVSGSLNEYGAQVLLSCSPGYYLEGWRLLRCQANGTWNIGDERPSCRAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFHLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 816854 - protein, 2109 aa, Homo sapiens
PSCPARPALVPGPGPASPGLRARSSSALQWLGTRCYEREASRAPRPSGGVGCAAGLGTGLSLRLALPSGDYLAPLIALPSSEEPSVSRACGVSADMTAWRRFQSLLLLLGLLVLCARLLTAAKGQNCGGLVQGPNGTIESPGFPHGYPNYANCTWIIITGERNRIQLSFHTFALEENFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSHMCLDPGIPENGRRAGSDFSRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDNGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKMTFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNTHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQDPSDQFCHGAELGLPFEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGK

SEQ ID NO: 816855 - protein, 2195 aa, Homo sapiens
PSCPARPALVPGPGPASPGLRARSSSALQWLGTRCYEREASRAPRPSGGVGCAAGLGTGLSLRLALPSGDYLAPLIALPSSEEPSVSRACGVSADMTAWRRFQSLLLLLGLLVLCARLLTAAKGQNCGGLVQGPNGTIESPGFPHGYPNYANCTWIIITGERNRIQLSFHTFALEENFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSHMCLDPGIPENGRRAGSDFSRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDNGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKMTFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNTHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQDPSDQFCHGAELGLPFEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQGMEQQREPKPKSKYTSYM

SEQ ID NO: 816856 - protein, 1467 aa, Homo sapiens
MIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPMCKPVACPSIEAQLSEHVIWRLVSGSLNEYGAQVLLSCSPGYYLEGWRLLRCQANGTWNIGDERPSCRAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFHLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 816857 - protein, 1662 aa, Homo sapiens
MFKKPLLGRVRWLMPVKPALWEAEAGGSRGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPMCKPVACPSIEAQLSEHVIWRLVSGSLNEYGAQVLLSCSPGYYLEGWRLLRCQANGTWNIGDERPSCRAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFHLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 816858 - protein, 2480 aa, Homo sapiens
PSCPARPALVPGPGPASPGLRARSSSALQWLGTRCYEREASRAPRPSGGVGCAAGLGTGLSLRLALPSGDYLAPLIALPSSEEPSVSRACGVSADMTAWRRFQSLLLLLGLLVLCARLLTAAKGQNCGGLVQGPNGTIESPGFPHGYPNYANCTWIIITGERNRIQLSFHTFALEENFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSHMCLDPGIPENGRRAGSDFSRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDNGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKMTFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNTHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQDPSDQFCHGAELGLPFEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGKFL

SEQ ID NO: 816859 - protein, 466 aa, Homo sapiens
PSCPARPALVPGPGPASPGLRARSSSALQWLGTRCYEREASRAPRPSGGVGCAAGLGTGLSLRLALPSGDYLAPLIALPSSEEPSVSRACGVSADMTAWRRFQSLLLLLGLLVLCARLLTAAKGQNCGGLVQGPNGTIESPGFPHGYPNYANCTWIIITGERNRIQLSFHTFALEENFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVWHQQEFSKCRKKKREIMTRNGRISLTASGNLQFDN

SEQ ID NO: 816860 - protein, 488 aa, Homo sapiens
AGNAVPVRRLSLFTLLTDLAPAFPSSSSKMGKSFANFMCKKDFHPASKSNIKKVWMAEQKISYDKKKQEELMQQYLKEQESYDNRLLMGDERVKNGLNFMYEAPPGAKKENKEKEETEGETEYKFEWQKGAPREKYAKDDMNIRDQPFGIQVRNVRCIKCHKWGHVNTDRECPLFGLSGINASSVPTDGSDAVYKLKVSGPSMHPSELIAEMRNSGFALKRNVLGRNLTANDPSQEYVASEGEEDPEVEFLKSLTTKQKQKLLRKLDRLEKKKKKKDRKKKKFQKSRSKHKKHKSSSSSSSSSSSSSSTETSESSSESESNNKEKKIQRKKRKKNKCSGHNNSDSEEKDKSKKRKLHEELSSSHHNREKAKEKPRFLKHESSREDSKWSHSDSDKKSRTHKHSPEKRGSERKEGSSRSHGREERSRRSRSRSPGSYKQRETRKRAQRNPGEEQSRRNDSRSHGTDLYRGEKMYREHPGGTHTKVTQRE

SEQ ID NO: 816861 - protein, 193 aa, Homo sapiens
AGNAVPVRRLSLFTLLTDLAPAFPSSSSKMGKSFANFMCKKDFHPASKSNIKKVWMAEQKISYDKKKQEELMQQYLKEQESYDNRLLMGDERVKNGLNFMYEAPPGAKKENKEKEETEGETEYKFEWQKGAPREKYAKDDMNIRDQPFGIQVRNVRCIKCHKWGHVNTDRECPLFGLSGINASSVPTDGSGRH

SEQ ID NO: 816862 - protein, 479 aa, Homo sapiens
AGNAVPVRRLSLFTLLTDLAPAFPSSSSKMGKSFANFMCKKDFHPASKSNIKKVWMAEQKISYDKKKQEELMQQYLKEQESYDNRLLMGDERVKNGLNFMYEAPPGAKKENKEKEETEGETEYKFEWQKGAPREKYAKDDMNIRDQPFGIQVRNVRCIKCHKWGHVNTDRECPLFGLSGINASSVPTDGSGPSMHPSELIAEMRNSGFALKRNVLGRNLTANDPSQEYVASEGEEDPEVEFLKSLTTKQKQKLLRKLDRLEKKKKKKDRKKKKFQKSRSKHKKHKSSSSSSSSSSSSSSTETSESSSESESNNKEKKIQRKKRKKNKCSGHNNSDSEEKDKSKKRKLHEELSSSHHNREKAKEKPRFLKHESSREDSKWSHSDSDKKSRTHKHSPEKRGSERKEGSSRSHGREERSRRSRSRSPGSYKQRETRKRAQRNPGEEQSRRNDSRSHGTDLYRGEKMYREHPGGTHTKVTQRE

SEQ ID NO: 816863 - protein, 479 aa, Homo sapiens; identical to SEQ ID NO: 816862

SEQ ID NO: 816864 - protein, 479 aa, Homo sapiens; identical to SEQ ID NO: 816862

SEQ ID NO: 816865 - protein, 447 aa, Homo sapiens
TTTKFAAASTFHPASKSNIKKVWMAEQKISYDKKKQEELMQQYLKEQESYDNRLLMGDERVKNGLNFMYEAPPGAKKENKEKEETEGETEYKFEWQKGAPREKYAKDDMNIRDQPFGIQVRNVRCIKCHKWGHVNTDRECPLFGLSGINASSVPTDGSGPSMHPSELIAEMRNSGFALKRNVLGRNLTANDPSQEYVASEGEEDPEVEFLKSLTTKQKQKLLRKLDRLEKKKKKKDRKKKKFQKSRSKHKKHKSSSSSSSSSSSSSSTETSESSSESESNNKEKKIQRKKRKKNKCSGHNNSDSEEKDKSKKRKLHEELSSSHHNREKAKEKPRFLKHESSREDSKWSHSDSDKKSRTHKHSPEKRGSERKEGSSRSHGREERSRRSRSRSPGSYKQRETRKRAQRNPGEEQSRRNDSRSHGTDLYRGEKMYREHPGGTHTKVTQRE

SEQ ID NO: 816866 - protein, 463 aa, Homo sapiens
AGNAVPVRRLSLFTLLTDLAPAFPSSSSKMGKSFANFMCKKDFHPASKSNIKKVWMAEQKISYDKKKQEELMQQYLKEQESYDNRLLMGDERVKNGLNFMYEAPPGAKKENKEKEETEGETEYKFEWQKGAPREKYAKDDMNIRDQPFGIQVRNVRCIKCHKWGHVNTDRECPLFGLSGINASSVPTDGSGPSMHPSELIAEMRNSGFALKRNVLGRNLTANDPSQEYVASEGEEDPEVEFLKSLTTKQKQKLLRKLDRLEKKKKKKDRKKKKFQKSRSKHKKHKSSSSSSSSSSSSSSTETSESSSESESNNKEKKIQRKKRKKNKCSGHNNSDSEEKDKSKKRKLHEELSSSHHNREKAKEKPRFLKHESSREDSKWSHSDSDKKSRTHKHSPEKRGSERKEGSSRSHGREERSRRSRSRSPGSYKHPPHKAQRPSLRRSRIPSHYDLFQRMKNMYIEHPG

SEQ ID NO: 816867 - protein, 450 aa, Homo sapiens
GEPEGSVKEIKHSPGPTRTVSTGTALSKYRSRSSDGQNYFEHEELTVSQLLLCLREGNQKVERLEVALKEAQERVSDFEKKTKEKEETEGETEYKFEWQKGAPREKYAKDDMNIRDQPFGIQVRNVRCIKCHKWGHVNTDRECPLFGLSGINASSVPTDGSGPSMHPSELIAEMRNSGFALKRNVLGRNLTANDPSQEYVASEGEEDPEVEFLKSLTTKQKQKLLRKLDRLEKKKKKKDRKKKKFQKSRSKHKKHKSSSSSSSSSSSSSSTETSESSSESESNNKEKKIQRKKRKKNKCSGHNNSDSEEKDKSKKRKLHEELSSSHHNREKAKEKPRFLKHESSREDSKWSHSDSDKKSRTHKHSPEKRGSERKEGSSRSHGREERSRRSRSRSPGSYKQRETRKRAQRNPGEEQSRRNDSRSHGTDLYRGEKMYREHPGGTHTKVTQRE

SEQ ID NO: 816868 - protein, 286 aa, Homo sapiens [sequence omitted]

SEQ ID NO: 816869 - protein, 245 aa, Homo sapiens
AGNAVPVRRLSLFTLLTDLAPAFPSSSSKMGKSFANFMCKKDFHPASKSNIKKVWMAEQKISYDKKKQEELMQQYLKEQESYDNRLLMGDERVKNGLNFMYEAPPGAKKENKEKEETEGETEYKFEWQKGAPREKYAKDDMNIRDQPFGIQVRNVRCIKCHKWGHVNTDRECPLFGLSGINASSVPTDGSGPSMHPSELIAEMRNSGFALKRNVLGRNLTANDPSQEYVAGRDEGRVGMMKGVQS

SEQ ID NO: 816870 - protein, 119 aa, Homo sapiens
RQLGCWSAAPPRRTGAAGGQRVRGWRGREWRPRGPGQGSAELQPSRASPLRVRGWVPPVTRRQPRAHQREGGCGGSGSPSHAVLCDEAGRGADGGGGGGESQRRGLPQPGVQATGNHRS

SEQ ID NO: 816871 - protein, 264 aa, Homo sapiens
MENYGIEWHSVRDSEGQKLLIGVGPEGISICKDDFSPINRIAYPVVQMATQSGKNVYLTVTKESGNSIVLLFKMISTRAASGLYRAITETHAFYRCDTVTSAVMMQYSRDLKGHLASLFLNENINLGKKYVFDIKRTSKEVYDHARRALYNAGVVDLVSRSNQSPSHSPLKSSESSMNCSSCEGLSCQQTRVLQEKLRKLKEAMLCMVCCEEEINSTFCPCGHTVCCESCAAQLQSCPVCRSRVEHVQHVYLPTHTSLLNLTVI

SEQ ID NO: 816872 - protein, 188 aa, Homo sapiens
MLCYVTRPDAVLMEVEVEAKANGEDCLNQVCRRLGIIEVDYFGLQFTGSKGESLWLNLRNRISQQMDGLAPYRLKLRVKFFVEPHLILQEQTRHIFFLHIKEALLAGHLLCSPEQAVELSALLAQTKFGDYNQNTAKYNYEELCAKELSSATLNSIVANIKDWSDHRSLNTVCNGGGTAKDPGKSEVG

SEQ ID NO: 816873 - protein, 445 aa, Homo sapiens [sequence omitted]

SEQ ID NO: 816874 - protein, 445 aa, Homo sapiens [sequence omitted]

SEQ ID NO: 816875 - protein, 445 aa, Homo sapiens [sequence omitted]

SEQ ID NO: 816876 - protein, 245 aa, Homo sapiens
MLCYVTRPDAVLMEVEVEAKANGEDCLNQVCRRLGIIEVDYFGLQFTGSKGESLWLNLRNRISQQMDGLAPYRLKLRVKFFVEPHLILQEQTRHIFFLHIKEALLAGHLLCSPEQAVELSALLAQTKFGDYNQNTAKYNYEELCAKELSSATLNSIVAKHKELEGTSQASAEYQVLQIVSAMENYGIEWHSVRDSEGQKLLIGVGPEGISICKDDFSPINRIAYPVVQMATQSGKNVYLWPHCVL

SEQ ID NO: 816877 - protein, 209 aa, Homo sapiens
SRLLLLNSRPLYIVLLFKMISTRAASGLYRAITETHAFYRCDTVTSAVMMQYSRDLKGHLASLFLNENINLGKKYVFDIKRTSKEVYDHARRALYNAGVVDLVSRSNQSPSHSPLKSSESSMNCSSCEGLSCQQTRVLQEKLRKLKEAMLCMVCCEEEINSTFCPCGHTVCCESCAAQLQSCPVCRSRVEHVQHVYLPTHTSLLNLTVI

SEQ ID NO: 816878 - protein, 1496 aa, Homo sapiens
FSWAALGTWIRWRGSWGASLFCVLVPPSCPSGEGKDKPWAMRLPLLLVFASVIPGAVLLLDTRQFLIYNEDHKRCVDAVSPSAVQTAACNQDAESQKFRWVSESQIMSVAFKLCLGVPSKTDWVAITLYACDSKSEFQKWECKNDTLLGIKGEDLFFNYGNRQEKNIMLYKGSGLWSRWKIYGTTDNLCSRGYEAMYTLLGNANGATCAFPFKFENKWYADCTSAGRSDGWLWCGTTTDYDTDKLFGYCPLKFEGSESLWNKDPLTSVSYQINSKSALTWHQARKSCQQQNAELLSITEIHEQTYLTGLTSSLTSGLWIGLNSLSFNSGWQWSDRSPFRYLNWLPGSPSAEPGKSCVSLNPGKNAKWENLECVQKLGYICKKGNTTLNSFVIPSESDVPTHCPSQWWPYAGHCYKIHRDEKKIQRDALTTCRKEGGDLTSIHTIEELDFIISQLGYEPNDELWIGLNDIKIQMYFEWSDGTPVTFTKWLRGEPSHENNRQEDCVVMKGKDGYWADRGCEWPLGYICKMKSRSQGPEIVEVEKGCRKGWKKHHFYCYMIGHTLSTFAEANQTCNNENAYLTTIEDRYEQAFLTSFVGLRPEKYFWTGLSDIQTKGTFQWTIEEEVRFTHWNSDMPGRKPGCVAMRTGIAGGLWDVLKCDEKAKFVCKHWAEGVTHPPKPTTTPEPKCPEDWGASSRTSLCFKLYAKGKHEKKTWFESRDFCRALGGDLASINNKEEQQTIWRLITASGSYHKLFWLGLTYGSPSEGFTWSDGSPVSYENWAYGEPNNYQNVEYCGELKGDPTMSWNDINCEHLNNWICQIQKGQTPKPEPTPAPQDNPPVTEDGWVIYKDYQYYFSKEKETMDNARAFCKRNFGDLVSIQSESEKKFLWKYVNRNDAQSAYFIGLLISLDKKFAWMDGSKVDYVSWATGEPNFANEDENCVTMYSNSGFWNDINCGYPNAFICQRHNSSINATTVMPTMPSVPSGCKEGWNFYSNKCFKIFGFMEEERKNWQEARKACIGFGGNLVSIQNEKEQAFLTYHMKDSTFSAWTGLNDVNSEHTFLWTDGRGVHYTNWGKGYPGGRRSSLSYEDADCVVIIGGASNEAGKWMDDTCDSKRGYICQTRSDPSLTNPPATIQTDGFVKYGKSSYSLMRQKFQWHEAETYCKLHNSLIASILDPYSNAFAWLQMETSNERVWIALNSNLTDNQYTWTDKWRVRYTNWAADEPKLKSACVYLDLDGYWKTAHCNESFYFLCKRSDEIPATEPPQLPGRCPESDHTAWIPFHGHCYYIESSYTRNWGQASLECLRMGSSLVSIESAAESSFLSYRVEPLKSKTNFWIGLFRNVEGTWLWINNSPVSFVNWNTGDPSGERNDCVALHASSGFWSNIHCSSYKGYICKRPKIIDAKPTHELLTTKADTRKMDPSKPSSNVAGVVIIVILLILTGAGLAAYFFYKKRRVHLPQEGAFENTLYFNSQSSPGTSDMKDLVGNIEQNEHSVI

SEQ ID NO: 816879 - protein, 1247 aa, Homo sapiens
AGVTPEDPGSTSKDPLTSVSYQINSKSALTWHQARKSCQQQNAELLSITEIHEQTYLTGLTSSLTSGLWIGLNSLSFNSGWQWSDRSPFRYLNWLPGSPSAEPGKSCVSLNPGKNAKWENLECVQKLGYICKKGNTTLNSFVIPSESDVPTHCPSQWWPYAGHCYKIHRDEKKIQRDALTTCRKEGGDLTSIHTIEELDFIISQLGYEPNDELWIGLNDIKIQMYFEWSDGTPVTFTKWLRGEPSHENNRQEDCVVMKGKDGYWADRGCEWPLGYICKMKSRSQGPEIVEVEKGCRKGWKKHHFYCYMIGHTLSTFAEANQTCNNENAYLTTIEDRYEQAFLTSFVGLRPEKYFWTGLSDIQTKGTFQWTIEEEVRFTHWNSDMPGRKPGCVAMRTGIAGGLWDVLKCDEKAKFVCKHWAEGVTHPPKPTTTPEPKCPEDWGASSRTSLCFKLYAKGKHEKKTWFESRDFCRALGGDLASINNKEEQQTIWRLITASGSYHKLFWLGLTYGSPSEGFTWSDGSPVSYENWAYGEPNNYQNVEYCGELKGDPTMSWNDINCEHLNNWICQIQKGQTPKPEPTPAPQDNPPVTEDGWVIYKDYQYYFSKEKETMDNARAFCKRNFGDLVSIQSESEKKFLWKYVNRNDAQSAYFIGLLISLDKKFAWMDGSKVDYVSWATGEPNFANEDENCVTMYSNSGFWNDINCGYPNAFICQRHNSSINATTVMPTMPSVPSGCKEGWNFYSNKCFKIFGFMEEERKNWQEARKACIGFGGNLVSIQNEKEQAFLTYHMKDSTFSAWTGLNDVNSEHTFLWTDGRGVHYTNWGKGYPGGRRSSLSYEDADCVVIIGGASNEAGKWMDDTCDSKRGYICQTRSDPSLTNPPATIQTDGFVKYGKSSYSLMRQKFQWHEAETYCKLHNSLIASILDPYSNAFAWLQMETSNERVWIALNSNLTDNQYTWTDKWRVRYTNWAADEPKLKSACVYLDLDGYWKTAHCNESFYFLCKRSDEIPATEPPQLPGRCPESDHTAWIPFHGHCYYIESSYTRNWGQASLECLRMGSSLVSIESAAESSFLSYRVEPLKSKTNFWIGLFRNVEGTWLWINNSPVSFVNWNTGDPSGERNDCVALHASSGFWSNIHCSSYKGYICKRPKIIDAKPTHELLTTKADTRKMDPSKPSSNVAGVVIIVILLILTGAGLAAYFFYKKRRVHLPQEGAFENTLYFNSQSSPGTSDMKDLVGNIEQNEHSVI

SEQ ID NO: 816880 - protein, 391 aa, Homo sapiens
MVADCVVIIGGASNEAGKWMDDTCDSKRGYICQTRSDPSLTNPPATIQTDGFVKYGYCKLHNSLIASILDPYSNAFAWLQMETSNERVWIALNSNLTDNQYTWTDKWRVRYTNWAADEPKLKSACVYLDLDGYWKTAHCNESFYFLCKRSDEIPATEPPQLPGRCPESDHTAWIPFHGHCYYIESSYTRNWGQASLECLRMGSSLVSIESAAESSFLSYRVEPLKSKTNFWIGLFRNVEGTWLWINNSPVSFVNWNTGDPSGERNDCVALHASSGFWSNIHCSSYKGYICKRPKIIDAKPTHELLTTKADTRKMDPSKPSSNVAGVVIIVILLILTGAGLAAYFFYKKRRVHLPQEGAFENTLYFNSQSSPGTSDMKDLVGNIEQNEHSVI

SEQ ID NO: 816881 - protein, 1478 aa, Homo sapiens
FSWAALGTWIRWRGSWGASLFCVLVPPSCPSGEGKDKPWAMRLPLLLVFASVIPGAVLLLDTRQFLIYNEDHKRCVDAVSPSAVQTAACNQDAESQKFRWVSESQIMSVAFKLCLGVPSKTDWVAITLYACDSKSEFQKWECKNDTLLGIKGEDLFFNYGNRQEKNIMLYKGSGLWSRWKIYGTTDNLCSRGYEAMYTLLGNANGATCAFPFKFENKWYADCTSAGRSDGWLWCGTTTDYDTDKLFGYCPLKFEGSESLWNKDPLTSVSYQINSKSALTWHQARKSCQQQNAELLSITEIHEQTYLTGLTSSLTSGLWIGLNSLSFNSGWQWSDRSPFRYLNWLPGSPSAEPGKSCVSLNPGKNAKWENLECVQKLGYICKKGNTTLNSFVIPSESDVPTHCPSQWWPYAGHCYKIHRDEKKIQRDALTTCRKEGGDLTSIHTIEELDFIISQLGYEPNDELWIGLNDIKIQMYFEWSDGTPVTFTKWLRGEPSHENNRQEDCVVMKGKDGYWADRGCEWPLGYICKMKSRSQGPEIVEVEKGCRKGWKKHHFYCYMIGHTLSTFAEANQTCNNENAYLTTIEDRYEQAFLTSFVGLRPEKYFWTGLSDIQTKGTFQWTIEEEVRFTHWNSDMPGRKPGCVAMRTGIAGGLWDVLKCDEKAKFVCKHWAEGVTHPPKPTTTPEPKCPEDWGASSRTSLCFKLYAKGKHEKKTWFESRDFCRALGGDLASINNKEEQQTIWRLITASGSYHKLFWLGLTYGSPSEGFTWSDGSPVSYENWAYGEPNNYQNVEYCGELKGDPTMSWNDINCEHLNNWICQIQKGQTPKPEPTPAPQDNPPVTEDGWVIYKDYQYYFSKEKETMDNARAFCKRNFGDLVSIQSESEKKFLWKYVNRNDAQSAYFIGLLISLDKKFAWMDGSKVDYVSWATGEPNFANEDENCVTMYSNSGFWNDINCGYPNAFICQRHNSSINATTVMPTMPSVPSGCKEGWNFYSNKCFKIFGFMEEERKNWQEARKACIGFGGNLVSIQNEKEQAFLTYHMKDSTFSAWTGLNDVNSEHTFLWTDGRGVHYTNWGKGYPGGRRSSLSYEDADCVVIIGGASNEAGKWMDDTCDSKRGYICQTRSDPSLTNPPATIQTDGFVKYGKSSYSLMRQKFQWHEAETYCKLHNSLIASILDPYSNAFAWLQMETSNERVWIALNSNLTDNQYTWTDKWRVRYTNWAADEPKLKSACVYLDLDGYWKTAHCNESFYFLCKRSDEIPATEPPQLPGRCPESDHTAWIPFHGHCYYIESSYTRNWGQASLECLRMGSSLVSIESAAESSFLSYRVEPLKSKTNFWIGLFRNVEGTWLWINNSPVSFVNWNTGDPSGERNDCVALHASSGFWSNIHCSSYKGYICKRPKIIDAKPTHELLTTKVIIVILLILTGAGLAAYFFYKKRRVHLPQEGAFENTLYFNSQSSPGTSDMKDLVGNIEQNEHSVI

SEQ ID NO: 816882 - protein, 1324 aa, Homo sapiens
FSWAALGTWIRWRGSWGASLFCVLVPPSCPSGEGKDKPWAMRLPLLLVFASVIPGAVLLLDTRQFLIYNEDHKRCVDAVSPSAVQTAACNQDAESQKFRWVSESQIMSVAFKLCLGVPSKTDWVAITLYACDSKSEFQKWECKNDTLLGIKGEDLFFNYGNRQEKNIMLYKGSGLWSRWKIYGTTDNLCSRGYEAMYTLLGNANGATCAFPFKFENKWYADCTSAGRSDGWLWCGTTTDYDTDKLFGYCPLKFEGSESLWNKDPLTSVSYQINSKSALTWHQARKSCQQQNAELLSITEIHEQTYLTGLTSSLTSGLWIGLNSLSFNSGWQWSDRSPFRYLNWLPGSPSAEPGKSCVSLNPGKNAKWENLECVQKLGYICKKGNTTLNSFVIPSESDVPTHCPSQWWPYAGHCYKIHRDEKKIQRDALTTCRKEGGDLTSIHTIEELDFIISQLGYEPNDELWIGLNDIKIQMYFEWSDGTPVTFTKWLRGEPSHENNRQEDCVVMKGKDGYWADRGCEWPLGYICKMKSRSQGPEIVEVEKGCRKGWKKHHFYCYMIGHTLSTFAEANQTCNNENAYLTTIEDRYEQAFLTSFVGLRPEKYFWTGLSDIQTKGTFQWTIEEEVRFTHWNSDMPGRKPGCVAMRTGIAGGLWDVLKCDEKAKFVCKHWAEGVTHPPKPTTTPEPKCPEDWGASSRTSLCFKLYAKGKHEKKTWFESRDFCRALGGDLASINNKEEQQTIWRLITASGSYHKLFWLGLTYGSPSEGFTWSDGSPVSYENWAYGEPNNYQNVEYCGELKGDPTMSWNDINCEHLNNWICQIQKGQTPKPEPTPAPQDNPPVTEDGWVIYKDYQYYFSKEKETMDNARAFCKRNFGDLVSIQSESEKKFLWKYVNRNDAQSAYFIGLLISLDKKFAWMDGSKVDYVSWATGEPNFANEDENCVTMYSNSGFWNDINCGYPNAFICQRHNSSINATTVMPTMPSVPSGCKEGWNFYSNKCFKIFGFMEEERKNWQEARKACIGFGGNLVSIQNEKEQAFLTYHMKDSTFSAWTGLNDVNSEHTFLWTDGRGVHYTNWGKGYPGGRRSSLSYEDADCVVIIGGASNEAGKWMDDTCDSKRGYICQTRSDPSLTNPPATIQTDGFVKYGKSSYSLMRQKFQWHEAETYCKLHNSLIASILDPYSNAFAWLQMETSNERVWIALNSNLTDNQYTWTDKWRVRYTNWAADEPKLKSACVYLDLDGYWKTAHCNESFYFLCKRSDDARSQITQHGFLSMVTVTILSPHIQETGAKLLWNVFEWVPLWFPLKVLQNPVFCHIGLSHLKVKPIFG

SEQ ID NO: 816883 - protein, 130 aa, Homo sapiens; identical to SEQ ID NO: 753405

SEQ ID NO: 816884 - protein, 112 aa, Homo sapiens
MRLFTGIVFCSLVMGVTSESWRSFFKEALQGVGDMGRAYWDIMISNHRPGGVWAAKLISRSRVYLQGLIDYYLFGNSSTVLEDSKSNEKAEEWGRSGKDPDRFRPDGLPKKY

SEQ ID NO: 816885 - protein, 252 aa, Homo sapiens
MSAAVACVDYFAADVLMAISSGAVVHRGRPGPEGAGPAAGLDVRAARREAASPGTPGPPPPPPAASGPGPGAAAAPHLLAASILADLRGGPGAAPGGASPASSSSAASSPSSGRAPGAAPSAAAKSHRCPFPDCAKAYYKSSHLKSHLRTHTGERPFACDWQGCDKKFARSDELARHHRTHTGEKRFSCPLCSKRFTRSDHLAKHARRHPGFHPDLLRRPGARSTSPSDSLPCSLAGSPAPSPAPSPAPAGL

SEQ ID NO: 816886 - protein, 122 aa, Homo sapiens
TRSGGERMAAPAAVAGAPGAQRGERPFACDWQGCDKKFARSDELARHHRTHTGEKRFSCPLCSKRFTRSDHLAKHARRHPGFHPDLLRRPGARSTSPSDSLPCSLAGSPAPSPAPSPAPAGL

SEQ ID NO: 816887 - protein, 252 aa, Homo sapiens; identical to SEQ ID NO: 816885

SEQ ID NO: 816888 - protein, 252 aa, Homo sapiens; identical to SEQ ID NO: 816885

SEQ ID NO: 816889 - protein, 252 aa, Homo sapiens; identical to SEQ ID NO: 816885

SEQ ID NO: 816890 - protein, 252 aa, Homo sapiens; identical to SEQ ID NO: 816885

SEQ ID NO: 816891 - protein, 268 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDPGSPKKCRARFGLNQQTDWCGPCR

SEQ ID NO: 816892 - protein, 269 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTGGKRNAFGTYPEKAAAPAPFLPMTVL

SEQ ID NO: 816893 - protein, 433 aa, Homo sapiens
AELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDPGSPKKCRARFGLNQQTDWCGPCRRKKKCIRYLPGEGRCPSPVPSDDSALGCPGSPAPQDSPSYHLLPRFPTELLTSPAEPAPTSPGLSTALSLPTPGPPQAPRSTLQSTQVQQQESQRQVA

SEQ ID NO: 816894 - protein, 323 aa, Homo sapiens
AELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTAQLEDWDGWARKP

SEQ ID NO: 816895 - protein, 321 aa, Homo sapiens
AELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDGIPACTILSP

SEQ ID NO: 816896 - protein, 317 aa, Homo sapiens
AELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDNSLHYS

SEQ ID NO: 816897 - protein, 297 aa, Homo sapiens
AELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYVSA

SEQ ID NO: 816898 - protein, 317 aa, Homo sapiens; identical to SEQ ID NO: 816896

SEQ ID NO: 816899 - protein, 269 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTETNWPRELKDGNGQESLSMSSSSSPA

SEQ ID NO: 816900 - protein, 169 aa, Homo sapiens
MGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTAQLEDWDGWARKP

SEQ ID NO: 816901 - protein, 433 aa, Homo sapiens; identical to SEQ ID NO: 816893

SEQ ID NO: 816902 - protein, 328 aa, Homo sapiens
AELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWPSPPLYPLSPSCGYRQHFPAPTAAPGAPYPRFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYVSA

SEQ ID NO: 816903 - protein, 147 aa, Homo sapiens
MWRALKNPTQTAHPVWSTGPPRVWGADRSTLRAVMSASVVSVISRFLEEYLSSTPQRLKLLDAYLLYILLTGALQFGYCLLVGTFPFNSFLSGFISCVGSFILAVCLRIQINPQNKADFQGISPERAFADFLFASTILHLVVMNFVG

SEQ ID NO: 816904 - protein, 147 aa, Homo sapiens
TAGEDDRRGQTAHPVWSTGPPRVWGADRSTLRAVMSASVVSVISRFLEEYLSSTPQRLKLLDAYLLYILLTGALQFGYCLLVGTFPFNSFLSGFISCVGSFILAVCLRIQINPQNKADFQGISPERAFADFLFASTILHLVVMNFVG

SEQ ID NO: 816905 - protein, 147 aa, Homo sapiens; identical to SEQ ID NO: 816904

SEQ ID NO: 816906 - protein, 147 aa, Homo sapiens; identical to SEQ ID NO: 816904

SEQ ID NO: 816907 - protein, 113 aa, Homo sapiens
MSASVVSVISRFLEEYLSSTPQRLKLLDAYLLYILLTGALQFGYCLLVGTFPFNSFLSGFISCVGSFILAVCLRIQINPQNKADFQGISPERAFADFLFASTILHLVVMNFVG

SEQ ID NO: 816908 - protein, 147 aa, Homo sapiens; identical to SEQ ID NO: 816904

SEQ ID NO: 816909 - protein, 147 aa, Homo sapiens; identical to SEQ ID NO: 816904

SEQ ID NO: 816910 - protein, 147 aa, Homo sapiens; identical to SEQ ID NO: 816903

SEQ ID NO: 816911 - protein, 147 aa, Homo sapiens; identical to SEQ ID NO: 816903

SEQ ID NO: 816912 - protein, 117 aa, Homo sapiens
TAGEDDRRGQTAHPVWSTGPPRVWGADRSTLRAVMSASVVSVISRFLEEYLSSTPQRLKLLDAYLLYILLTGALQFGYCLLVGTFPFNSFLSGFISCVGSFILAAWTLCCCLKCIPI

SEQ ID NO: 816913 - protein, 99 aa, Homo sapiens
TAGEDDRRGQTAHPVWSTGPPRVWGADRSTLRAVMSASVVSVISRFLEEYLSSTPQRLKLLDAYLLYILLTGALHLPENTDQPTEQSGFPRHLPRASLC

SEQ ID NO: 816914 - protein, 117 aa, Homo sapiens
MAETPPFSVARWQKMSLACRLSLIILFTGAVREYEHGQERETNRRPATAQVVSVKQHRTEDDQHDTTQRQPQPTAPYDATEPLNAHHNDQPDQDRHTKSTAGSQTSTDRPLTGCRAP

SEQ ID NO: 816915 - protein, 99 aa, Homo sapiens; identical to SEQ ID NO: 816913

SEQ ID NO: 816916 - protein, 112 aa, Homo sapiens
TAGEDDRRGQTAHPVWSTGPPRVWGADRSTLRAVMSASVVSVISRFLEEYLSSTPQRLKLLDAYLLYILLTGALQFGYCLLVGTFPFNSFLSGFISCVGSFILAGSLFEFPG

SEQ ID NO: 816917 - protein, 112 aa, Homo sapiens; identical to SEQ ID NO: 816916

SEQ ID NO: 816918 - protein, 128 aa, Homo sapiens
TAGEDDRRGQTAHPVWSTGPPRVWGADRSTLRAVMSASVVSVISRFLEEYLSSTPQRLKLLDAYLLYILLTGALQFGYCLLVGTFPFNSFLSGFISCVGSFILAGNGSISDHNNNVLLWCAAFVFIVL

SEQ ID NO: 816919 - protein, 180 aa, Homo sapiens
SLKPQLLGPGHPVSPYLLFLSSSDCAMGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 816920 - protein, 167 aa, Homo sapiens
ARTAGEKGSCDCAMGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 816921 - protein, 140 aa, Homo sapiens
GGHLEDRYPRVWVGSPHLLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 816922 - protein, 161 aa, Homo sapiens
SLKPQLLGPGHPVSPYLLFLSSSDCAMGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKG

SEQ ID NO: 816923 - protein, 180 aa, Homo sapiens; identical to SEQ ID NO: 816919

SEQ ID NO: 816924 - protein, 109 aa, Homo sapiens
SLKPQLLGPGHPVSPYLLFLSSSDCAMGLSDGEWQLVLNVWGKVEADIPGHGQEVLIRLFKGHPETLEKFDKFKHLKSEDEMKAASLWDVITLGTGSGPWLTVFCMVWI

SEQ ID NO: 816925 - protein, 207 aa, Homo sapiens
SLKPQLLGPGHPVSPYLLFLSSSDCAMGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMAPTHLGPGFKRERGLISCSHIEFASECLLCLVEVGRRS

SEQ ID NO: 816926 - protein, 154 aa, Homo sapiens
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 816927 - protein, 166 aa, Homo sapiens
MELGCQVCKYCAMGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 816928 - protein, 133 aa, Homo sapiens
CEDSWGEGELWLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 816929 - protein, 181 aa, Homo sapiens
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMAPTHLGPGFKRERGLISCSHIEFASECLLCLVEVGRRS

SEQ ID NO: 816930 - protein, 283 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMVRHTALSSNAMGEMFLAHLNGYFPILSCHQALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 816931 - protein, 253 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 816932 - protein, 127 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKV

SEQ ID NO: 816933 - protein, 277 aa, Homo sapiens
MSKSLKKLVEESREKNQPEVDMSDRGISNMLDVNGLFTLSHITQLVLSHNKLTMVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKLTKLQILSLRDNDLISLPKEIGELTQLKELHIQGNRLTVLPPELGNLDLTGQKQVFKAENNPWVTPIADQFQLGVSHVFEYIRSETYKYLYGRHMQANPEPPKKNNDKSKKISRKPLAAKNR

SEQ ID NO: 816934 - protein, 426 aa, Homo sapiens
AWPWRHVWRAVLLIWVGSGVELAAALCAPARGAETGRVRCSVPVLQGVRAAGVRSAEACGCTPIVLGATFRGECVRCCTWGCFSLRGRSGAEPFPLHPLPAPGPAPGTPSDAHPLQPWGSLRVAAKASCLSASALAVIAHVLCCCSVQTMSKSLKKLVEESREKNQPEVDMSDRGISNMLDVNGLFTLSHITQLVLSHNKLTMVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKLTKLQILSLRDNDLISLPKEIGELTQLKELHIQGNRLTVLPPELGNLDLTGQKQVFKAENNPWVTPIADQFQLGVSHVFEYIRSETYKYLYGRHMQANPEPPKKNNDKSKKISRKPLAAKNR

SEQ ID NO: 816935 - protein, 277 aa, Homo sapiens; identical to SEQ ID NO: 816933

SEQ ID NO: 816936 - protein, 277 aa, Homo sapiens; identical to SEQ ID NO: 816933

SEQ ID NO: 816937 - protein, 277 aa, Homo sapiens; identical to SEQ ID NO: 816933

SEQ ID NO: 816938 - protein, 426 aa, Homo sapiens; identical to SEQ ID NO: 816934

SEQ ID NO: 816939 - protein, 237 aa, Homo sapiens
MESTGTLIINLLPVVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKLTKLQILSLRDNDLISLPKEIGELTQLKELHIQGNRLTVLPPELGNLDLTGQKQVFKAENNPWVTPIADQFQLGVSHVFEYIRSETYKYLYGRHMQANPEPPKKNNDKSKKISRKPLAAKNR

SEQ ID NO: 816940 - protein, 225 aa, Homo sapiens
MSKSLKKLVEESREKNQPEVDMSDRGISNMLDVNGLFTLSHITQLVLSHNKLTMVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKLTKLQILSLRDNDLISLPKEIGELTQLKELHIQGNRLTVLPPELGNLDLTGQKQPLRQTHAGQPRTTEEE

SEQ ID NO: 816941 - protein, 92 aa, Homo sapiens
RVYPSREAVRRGKESYSYRPCWPTQNHRRRIMTNRKRSAGNPWQPRTDKEGIGIGWPSSTFSLQHFILSCPVSQINPMLRVRPFLFFFSLSF

SEQ ID NO: 816942 - protein, 205 aa, Homo sapiens
MSKSLKKLVEESREKNQPEVDMSDRGISNMLDVNGLFTLSHITQLVLSHNKLTMVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKLTKLQILSLRDNDLISLPKEIGELTQLKELHIQGNRLTVLPPELGKVADE

SEQ ID NO: 816943 - protein, 90 aa, Homo sapiens
TMSKSLKKLVEESREKNQPEVDMSDRGISNMLDVNGLCEFSGRTLPWMELEGFLSLPIHCWSCCERLYWFRPQPLLVNLTCQGLRAEGLQ

SEQ ID NO: 816944 - protein, 277 aa, Homo sapiens; identical to SEQ ID NO: 816933

SEQ ID NO: 816945 - protein, 95 aa, Homo sapiens
AWPWRHVWRAVLLIWVGSGVELAAALCAPARGAETGRVRCSVPVLQGVRAAGVRSAEACGCTPIVLGATFRDHVQVSEEVGGGEPGEEPARGGHE

SEQ ID NO: 816946 - protein, 312 aa, Homo sapiens
AWPWRHVWRAVLLIWVGSGVELAAALCAPARGAETGRVRCSVPVLQGVRAAGVRSAEACGCTPIVLGATFRVTLSHITQLVLSHNKLTMVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKLTKLQILSLRDNDLISLPKEIGELTQLKELHIQGNRLTVLPPELGNLDLTGQKQVFKAENNPWVTPIADQFQLGVSHVFEYIRSETYKYLYGRHMQANPEPPKKNNDKSKKISRKPLAAKNR

SEQ ID NO: 816947 - protein, 243 aa, Homo sapiens
MSKSLKKLVEESREKNQPEVDMSDRGISNMLDVNGLFTLSHITQLVLSHNKLTMVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKLTKLQILSLRDNDLISLPKEIGELTQLKELHIQGNRLTVLPPELGNLDLTGQKQVFKAENNPWVTPIADQFQLGVSHVFEYIRSETYK

SEQ ID NO: 816948 - protein, 225 aa, Homo sapiens; identical to SEQ ID NO: 816940

SEQ ID NO: 816949 - protein, 205 aa, Homo sapiens; identical to SEQ ID NO: 816942

SEQ ID NO: 816950 - protein, 351 aa, Homo sapiens
ILCVSSDAQPQTFGRVKGAHPPTLPPGSFLPIPVLWWGSIARLQIEKSDEVSRKGNWQVTEMGGGTGERLFTPSCLVGLVPLGLRISLVTCPLQCGIMWQLLLPTALLLLVSAGMRTEDLPKAVVFLEPQWYSVLEKDSVTLKCQGAYSPEDNSTQWFHNESLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFFPPGYQVSFCLVMVLLFAVDTGLYFSVKTNIRSSTRDWKDHKFKWRKDPQDK

SEQ ID NO: 816951 - protein, 351 aa, Homo sapiens; identical to SEQ ID NO: 816950

SEQ ID NO: 816952 - protein, 254 aa, Homo sapiens
MWQLLLPTALLLLVSAGMLTEDLPKAVVFLEPQWYSVLEKDSVTLKCQGAYSPEDNSTQWFHNESLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNIRSSTRDWKDHKFKWRKDPQDK

SEQ ID NO: 816953 - protein, 136 aa, Homo sapiens
KQWYQRRVPITAGGGIMWQLLLPTALLLLVSAGMRTEDLPKAVVFLEPQWYSVLEKDSVTLKCQGAYSPEDNSTQWFHNESLISSQASSYFIDAATVNDSGEYRCQTNLSTLSDPVQLEVHIGELMKGKRKITNKG

SEQ ID NO: 816954 - protein, 351 aa, Homo sapiens; identical to SEQ ID NO: 816950

SEQ ID NO: 816955 - protein, 351 aa, Homo sapiens; identical to SEQ ID NO: 816950

SEQ ID NO: 816956 - protein, 270 aa, Homo sapiens
KQWYQRRVPITAGGGIMWQLLLPTALLLLVSAGMRTEDLPKAVVFLEPQWYSVLEKDSVTLKCQGAYSPEDNSTQWFHNESLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNIRSSTRDWKDHKFKWRKDPQDK

SEQ ID NO: 816957 - protein, 126 aa, Homo sapiens
MWQLLLPTALLLLVSAGMLTEDLPKAVVFLEPQWYSVLEKDSVTLKCQGAYSPEDNSTQWFHNESLISSQASSYFIDAATVNDSGEYRCQTNLSTLSDPVQLEVHIGHFPTMTSCSLFVKSDYLVT

SEQ ID NO: 816958 - protein, 985 aa, Homo sapiens
FIRCTVSMSLPKQLKLTCNEHLQSGRNLGVSAPQMQKESVIKEENSLRIVPKKPQRHSLPATGVLKKAASEELLEKSSYPSSEEKSSEKSLERNHLQHLCAQNRGVSSSFDMPKRASEKPVWKLPHPILPFSGNPEFLKSVTVSSNSEPSTALTKPRAKSLSAMDVEKCTKPCKDSTKKNSFKKLLSMKLSICFMKSDFQKFWSKSSQLGDTTTGHLSSGEQKGIESDWQGLLVGEEKRSKPIKAYSTENYSLESQKKRKKSRGQTSAANGLRAESLDDQMLSRESSSQAPYKSVTSLCAPEYENIRHYEEIPEYENLPFIMAIRKTQELEWQNSSSMEDADANVYEVEEPYEAPDGQLQLGPRHQHSSSGASQEEQNDLGLGDLPSDEEEIINSSDEDDVSSESSKGEPDPLEDKQDEDNGMKSKVHHIAKEIMSSEKVFVDVLKLLHIDFRDAVAHASRQLGKPVIEDRILNQILYYLPQLYELNRDLLKELEERMLHWTEQQRIADIFVKKGPYLKMDSTYIKEFDKNIALLDEQCKKNPGFAAVVREFEMSPRCANLALKHYLLKPVQRIPQYRLLLTDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENKEEVSPLGSKAPIWIPDTRATMCMICTSEFTLTWRRHHCRACGKIVCQACSSNKYGLDYLKNQPARVCEHCFQELQKLDHQHSPRIGSPGNHKSPSSALSSVLHSIPSGRKQKKIPAALKEVSANTEDSSMSGYLYRSKGNKKPWKHFWFVIKNKVLYTYAASEDVAALESQPLLGFTVIQVKDENSESKVFQLLHKNMLFYVFKAEDAHSAQKWIEAFQEGTIL

SEQ ID NO: 816959 - protein, 929 aa, Homo sapiens
FIRCTVSMSLPKQLKLTCNEHLQSGRNLGVSAPQMQKESVIKEENSLRIVPKKPQRHSLPATGVLKKAASEELLEKSSYPSSEEKSSEKSLERNHLQHLCAQNRGVSSSFDMPKRASEKPVWKLPHPILPFSGNPEFLKSVTVSSNSEPSTALTKPRAKSLSAMDVEKCTKPCKDSTKKNSFKKLLSMKLSICFMKSDFQKFWSKSSQLGDTTTGHLSSGEQKGIESDWQGLLVGEEKRSKPIKAYSTENYSLESQKKRKKSRGQTSAANGLRAESLDDQMLSRESSSQAPYKSVTSLCAPEYENIRHYEEIPEYENLPFIMAIRKTQELEWQNSSSMEDADANVYEVEEPYEAPDGQLQLGPRHQHSSSGASQEEQNDLGLGDLPSDEEEIINSSDEDDVSSESSKGEPDPLEDKQDEDNGMKSKVHHIAKEIMSSEKVFVDVLKLLHIDFRDAVAHASRQLGKPVIEDRILNQILYYLPQLYELNRDLLKELEERMLHWTEQQRIADIFVKKGPYLKMDSTYIKEFDKNIALLDEQCKKNPGFAAVVREFEMSPRCANLALKHYLLKPVQRIPQYRLLLTDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENKEEVSPLGSKAPIWIPDTRATMCMICTSEFTLTWRRHHCRACGKIVCQACSSNKYGLDYLKNQPARVCEHCFQELQKLDHQHSPRIGSPGNHKSPSSALSSVLHSIPSGRKQKKIPAALKEVSANTEDSSMSGYLYRSKGNKKPWKHFWFVIKNKVLYTYAASEVRSEI

SEQ ID NO: 816960 - protein, 393 aa, Homo sapiens
FIRCTVSMSLPKQLKLTCNEHLQSGRNLGVSAPQMQKESVIKEENSLRIVPKKPQRHSLPATGVLKKAASEELLEKSSYPSSEEKSSEKSLERNHLQHLCAQNRGVSSSFDMPKRASEKPVWKLPHPILPFSGNPEFLKSVTVSSNSEPSTALTKPRAKSLSAMDVEKCTKPCKDSTKKNSFKKLLSMKLSICFMKSDFQKFWSKSSQLGDTTTGHLSSGEQKGIESDWQGLLVGEEKRSKPIKAYSTENYSLESQKKRKKSRGQTSAANGLRAESLDDQMLSRESSSQAPYKSVTSLCAPEYENIRHYEEIPEYENLPFIMAIRKTQELEWQNSSSMEDADANVYEVEEPYEAPDGQLQLGPRHQHSRSRSVNPGWSAVARSQLTAASTSQT

SEQ ID NO: 816961 - protein, 929 aa, Homo sapiens; identical to SEQ ID NO: 816959

SEQ ID NO: 816962 - protein, 114 aa, Homo sapiens
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDSGNKKN

SEQ ID NO: 816963 - protein, 114 aa, Homo sapiens; identical to SEQ ID NO: 816962

SEQ ID NO: 816964 - protein, 114 aa, Homo sapiens; identical to SEQ ID NO: 816962

SEQ ID NO: 816965 - protein, 127 aa, Homo sapiens [sequence omitted]

SEQ ID NO: 816966 - protein, 233 aa, Homo sapiens
RACVAPVPVAPVPVAPLPPLTMGPGPRLLLPLVLCVGLGALVFSSGAEGFRKRGPSVTAKVFFDVRIGDKDVGRIVIGLFGKVVPKTVENFVALATGEKGYGYKGSKFHRVIKDFMIQGGDITTGDGTGGVSIYGETFPDENFKLKHYGIGWVSMANAGPDTNGSQFFITLTKPTWLDGKHVVFGKVIDGMTVVHSIELQATDGHDRPLTSCSIINSGKIDVKTPFVVEIADW

SEQ ID NO: 816967 - protein, 246 aa, Homo sapiens
GVGESGGRRHSGPGRREPQRETDFKMKVAPDKTCMQFSIRRPKLPSSETHPEESMYKRLGVSAWLNHLNELGQVEEEYKLRKAIFFGGIDVSIRGEVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLVRLRGMG

SEQ ID NO: 816968 - protein, 463 aa, Homo sapiens
GVGESGGRRHSGPGRREPQRETDFKMKVAPDKTCMQFSIRRPKLPSSETHPEESMYKRLGVSAWLNHLNELGQVEEEYKLRKAIFFGGIDVSIRGEVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLLYLRELLRLTHVRFYQHLVSLGEDGLQMLFCHRWLLLCFKREFPEAEALRIWEACWAHYQTDYFHLFICVAIVAIYGDDVIEQQLATDQMLLHFGNLAMHMNGELVLRKARSLLYQFRLLPRIPCSLHDLCKLCGSGMWDSGSMPAVECTGHHPGSESCPYGGTVEMPSPKSLREGKKGPKTPQDGSASADRSGPRHRTGVEGTSSEALGTGGGGAGREGDRGR

SEQ ID NO: 816969 - protein, 429 aa, Homo sapiens
MQFSIRRPKLPSSETHPEESMYKRLGVSAWLNHLNELGQVEEEYKLRKAIFFGGIDVSIRGEVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLLYLRELLRLTHVRFYQHLVSLGEDGLQMLFCHRWLLLCFKREFPEAEALRIWEACWAHYQTDYFHLFICVAIVAIYGDDVIEQQLATDQMLLHFGNLAMHMNGELVLRKARSLLYQFRLLPRIPCSLHDLCKLCGSGMWDSGSMPAVECTGHHPGSESCPYGGTVEMPSPKSLREGKKGPKTPQDGSASADRSGPRHRTGVEGTSSEALGTGGGGAGREGDRGR

SEQ ID NO: 816970 - protein, 453 aa, Homo sapiens
DVFQQWKYCTEMQLKDQVAPDKTCMQFSIRRPKLPSSETHPEESMYKRLGVSAWLNHLNELGQVEEEYKLRKAIFFGGIDVSIRGEVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLLYLRELLRLTHVRFYQHLVSLGEDGLQMLFCHRWLLLCFKREFPEAEALRIWEACWAHYQTDYFHLFICVAIVAIYGDDVIEQQLATDQMLLHFGNLAMHMNGELVLRKARSLLYQFRLLPRIPCSLHDLCKLCGSGMWDSGSMPAVECTGHHPGSESCPYGGTVEMPSPKSLREGKKGPKTPQDGSASADRSGPRHRTGVEGTSSEALGTGGGGAGREGDRGR

SEQ ID NO: 816971 - protein, 439 aa, Homo sapiens
DVFQQWKYCTEMQLKDQVAPDKTCMQFSIRRPKLPSSETHPEESMYKRLGVSAWLNHLNELGQVEEEYKLRKVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLLYLRELLRLTHVRFYQHLVSLGEDGLQMLFCHRWLLLCFKREFPEAEALRIWEACWAHYQTDYFHLFICVAIVAIYGDDVIEQQLATDQMLLHFGNLAMHMNGELVLRKARSLLYQFRLLPRIPCSLHDLCKLCGSGMWDSGSMPAVECTGHHPGSESCPYGGTVEMPSPKSLREGKKGPKTPQDGSASADRSGPRHRTGVEGTSSEALGTGGGGAGREGDRGR

SEQ ID NO: 816972 - protein, 303 aa, Homo sapiens
GVGESGGRRHSGPGRREPQRETDFKMKVAPDKTCMQFSIRRPKLPSSETHPEESMYKRLGVSAWLNHLNELGQVEEEYKLRKAIFFGGIDVSIRGEVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLLYLRELLRLTHVRFYQHLVSLGEDGLQMLFCHRWLLLCFKREFPEAEALRIWEACWAHYQGADV

SEQ ID NO: 816973 - protein, 85 aa, Homo sapiens
STHPGGLDPFAGAGSIHHGSSSSLRQRTLKMEANTHLLEDICVSVSCPHSHRRGLMSDESESEATECRYHTPPLHAVIGSPLARV

SEQ ID NO: 816974 - protein, 463 aa, Homo sapiens; identical to SEQ ID NO: 816968

SEQ ID NO: 816975 - protein, 415 aa, Homo sapiens
MQFSIRRPKLPSSETHPEESMYKRLGVSAWLNHLNELGQVEEEYKLRKVWPFLLRYYSHESTSEEREALRLQKRKEYSEIQQKRLSMTPEEHRAFWRNVQFTVDKDVVRTDRNNQFFRGEDNPNVESMRRILLNYAVYNPAVGYSQGMSDLVAPILAEVLDESDTFWCFVGLMQNTIFVSSPRDEDMEKQLLYLRELLRLTHVRFYQHLVSLGEDGLQMLFCHRWLLLCFKREFPEAEALRIWEACWAHYQTDYFHLFICVAIVAIYGDDVIEQQLATDQMLLHFGNLAMHMNGELVLRKARSLLYQFRLLPRIPCSLHDLCKLCGSGMWDSGSMPAVECTGHHPGSESCPYGGTVEMPSPKSLREGKKGPKTPQDGSASADRSGPRHRTGVEGTSSEALGTGGGGAGREGDRGR

SEQ ID NO: 816976 - protein, 102 aa, Homo sapiens
MLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMRRK

SEQ ID NO: 816977 - protein, 217 aa, Homo sapiens
LVWARWTGRGGGNQKRLVAAACVPNPLRAALATRVPGVGASGGASCVLSLGAAAICSGKHQGVPAALSSKSATMEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRRK

SEQ ID NO: 816978 - protein, 102 aa, Homo sapiens; identical to SEQ ID NO: 816976

SEQ ID NO: 816979 - protein, 204 aa, Homo sapiens
LVWARWTGRGGGNQKRLVAAACVPNPLRAALATRVPGVGASGGASCVLSLGAAAICSGKHQGVPAALSSKSATMEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMRRK

SEQ ID NO: 816980 - protein, 175 aa, Homo sapiens
RLVAPKLGSERIARRGGGSAARLRETLPARGPAFRGQVNVTGPLTSSRSTRLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMRRK

SEQ ID NO: 816981 - protein, 239 aa, Homo sapiens
LVWARWTGRGGGNQKRLVAAACVPNPLRAALATRVPGVGASGGASCVLSLGAAAICSGKHQGVPAALSSKSATMEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRNSPTFKSFEERVETTVTSLKVQMK

SEQ ID NO: 816982 - protein, 204 aa, Homo sapiens; identical to SEQ ID NO: 816979

SEQ ID NO: 816983 - protein, 277 aa, Homo sapiens
LVWARWTGRGGGNQKRLVAAACVPNPLRAALATRVPGVGASGGASCVLSLGAAAICSGKHQGVPAALSSKSATMEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRNSPTFKSFEERVETTVTSLKTKVGGTNPNGGSFEEVLSSTAHASAQSLAGGSRRTKEEELQC

SEQ ID NO: 816984 - protein, 204 aa, Homo sapiens; identical to SEQ ID NO: 816979

SEQ ID NO: 816985 - protein, 275 aa, Homo sapiens
MNLMNELKQNFSKSWHDMQTTTAYKKTHETLSHAGQKATRRPKHPSDVFFFKKHEHTTYSIPLSISMPDMRNPLTRNTLDDRADPLVSNLRKNSTSHKPIKNGMARRRTQLTLPKQNTQTLGHHAKPQTPYRKGCLNITLLTQPTEAKSIRQLTFPFYDTGPSKLQYSIRPTQRSKLSLRSTAHITYYNHQHVPEPDHETVHDKSIKQASMKSLPTIQRTARYAYINCQQHAWYKQKYPTRTSTRDVGRLLAAADLNKRKKQSQNTLVSLYPGTI

SEQ ID NO: 816986 - protein, 102 aa, Homo sapiens; identical to SEQ ID NO: 816976

SEQ ID NO: 816987 - protein, 204 aa, Homo sapiens; identical to SEQ ID NO: 816979

SEQ ID NO: 816988 - protein, 204 aa, Homo sapiens; identical to SEQ ID NO: 816979

SEQ ID NO: 816989 - protein, 120 aa, Homo sapiens
HEGSWCCYRRGGGVFFFNPQKGGPPLFFLKFPPPKGGPQNPKGAPPFLPNRVFVLGPPLLSPLGQKLPNAVPCSAGVYSLSAPGDPRVVSISQRIRQGHSPLRQPGHLSIIKSSDGKITV

SEQ ID NO: 816990 - protein, 205 aa, Homo sapiens
MLRALSRLGAGTPCRPRAPLVLPARGRKTRHDPLAKSKIERVNMPPAVDPAEFFVLMERYQHYRQTVRALRMEFVSEVQRKVHEARAGVLAERKALKDAAEHRELMAWNQAENRRLHELRIARLRQEEREQEQRQALEQARKAEEVQAWAQRKEREVLQLQEEVKNFITRENLEARVEAALDSRKNYNWAITREGLVVRPQRRDS

SEQ ID NO: 816991 - protein, 205 aa, Homo sapiens; identical to SEQ ID NO: 816990

SEQ ID NO: 816992 - protein, 189 aa, Homo sapiens
MLRALSRLGAGTPCRPRAPLVLPARGRKTRHDPLAKSKIERVNMPPAVDPAEFFVLMERYQHYRQTVRALRMEFVSEVQRKVHEARAGVLAERKALKDAAEHRELMAWNQAENRRLHELRCVGREAAEEVQAWAQRKEREVLQLQEEVKNFITRENLEARVEAALDSRKNYNWAITREGLVVRPQRRDS

SEQ ID NO: 816993 - protein, 246 aa, Homo sapiens [sequence omitted]

SEQ ID NO: 816994 - protein, 205 aa, Homo sapiens; identical to SEQ ID NO: 816990

SEQ ID NO: 816995 - protein, 205 aa, Homo sapiens; identical to SEQ ID NO: 816990

SEQ ID NO: 816996 - protein, 210 aa, Homo sapiens
SSSVHLSPTLMLGRGWVLIGRLGHATRAEPPGRGDPVQAPGPSGAASARPQDPPRPAGQIQDRRYQHYRQTVRALRMEFVSEVQRKVHEARAGVLAERKALKDAAEHRELMAWNQAENRRLHELRIARLRQEEREQEQRQALEQARKAEEVQAWAQRKEREVLQLQEEVKNFITRENLEARVEAALDSRKNYNWAITREGLVVRPQRRDS

SEQ ID NO: 816997 - protein, 137 aa, Homo sapiens
QTLNYVVGDEPDASWDEALVKGQRPELRCLHGAVENALILPLGVHQASLQHIQGLAQERGNIQPGIKQLVLLMRKVQPYPAQPSRFALCCHHLVRNFQTQCPVLPVCTASAHQETLEWFPSHRESDRATAPSGSQVI

SEQ ID NO: 816998 - protein, 74 aa, Homo sapiens
GAATCGTCPGVGVWGPLAWSGLVLAGLDPSTISALEPAAGPNSVFPEFSCYDPSLADRILVMRPNRKQSTGKQK

SEQ ID NO: 816999 - protein, 105 aa, Homo sapiens
YAGTTSDVHQEAKHREAEMRNSILAQVLDQSARARLSNLALVKPEKTKAVENYLIQMARYGQLSEKVSEQGLIEILKKVSQQTEKTTTVKFNRRKVMDSDEDDDY

SEQ ID NO: 817000 - protein, 114 aa, Homo sapiens
LAELTFNSTAQDPGDAAQQEAKHREAEMRNSILAQVLDQSARARLSNLALVKPEKTKAVENYLIQMARYGQLSEKVSEQGLIEILKKVSQQTEKTTTVKFNRRKVMDSDEDDDY

SEQ ID NO: 817001 - protein, 131 aa, Homo sapiens
MADEELEALRRQRLAELQAKHGDPGDAAQQEAKHRYGLENVNFLKGGFTKWISFAVVILSRCVTQIFLFCWNGDLAKIIRRVSSLLLNKHVCSSTSDLVLQLLVDVSLLQCEYLKNEPDNRQLWQFPRLWG

SEQ ID NO: 817002 - protein, 125 aa, Homo sapiens
MADEELEALRRQRLAELQAKHGDPGDAAQQEAKHREAEMRNSILAQVLDQSARARLSNLALVKPEKTKAVENYLIQMARYGQLSEKVSEQGLIEILKKVSQQTEKTTTVKFNRRKVMDSDEDDDY

SEQ ID NO: 817003 - protein, 145 aa, Homo sapiens
AAAYYYYYCSEFKLLTMYGAMADEELEALRRQRLAELQAKHGDPGDAAQQEAKHREAEMRNSILAQVLDQSARARLSNLALVKPEKTKAVENYLIQMARYGQLSEKVSEQGLIEILKKVSQQTEKTTTVKFNRRKVMDSDEDDDY

SEQ ID NO: 817004 - protein, 109 aa, Homo sapiens
YAGTTSDVHQEAKHREAEMRNSILAQVLDQSARARLSNLALVKPEKTKAVENYLIQMARYGQLSEKVSLDSLEELYCYLLYQNMASKGQLHLHWITEFLLTLRRNCWRE

SEQ ID NO: 817005 - protein, 129 aa, Homo sapiens
MADEELEALRRQRLAELQAKHGDPGDAAQQEAKHREAEMRNSILAQVLDQSARARLSNLALVKPEKTKAVENYLIQMARYGQLSEKVSLDSLEELYCYLLYQNMASKGQLHLHWITEFLLTLRRNCWRE

SEQ ID NO: 817006 - protein, 125 aa, Homo sapiens; identical to SEQ ID NO: 817002

SEQ ID NO: 817007 - protein, 96 aa, Homo sapiens
STHCFLTRSTPWKDAHKGTWAVARARLSNLALVKPEKTKAVENYLIQMARYGQLSEKVSEQGLIEILKKVSQQTEKTTTVKFNRRKVMDSDEDDDY

SEQ ID NO: 817008 - protein, 125 aa, Homo sapiens; identical to SEQ ID NO: 817002

SEQ ID NO: 817009 - protein, 129 aa, Homo sapiens; identical to SEQ ID NO: 817005

SEQ ID NO: 817010 - protein, 250 aa, Homo sapiens
GHRFNHDWRSAVISERLSACPPSRRVAGACASRSTSLLLSRPRPGGPEREAGTMFRRKLTALDYHNPAGFNCKDETEFRNFIVWLEDQKIRHYKIEDRGNLRNIHSSDWPKFFEKYLRDVNCPFKIQDRQEAIDWLLGLAVRLEYGDNAEKYKDLVPDNSKTADNATKNAEPLINLDVNNPDFKAGVMALANLLQIQRHDDYLVMLKAIRILVQERLTQDAVAKANQTKEGLPVALDKHILGFDTGGCSS

SEQ ID NO: 817011 - protein, 190 aa, Homo sapiens
PLLTVCFTLRYDNPEFTNFIVRLDDQKIRHYSDSSSQEFTNTSTVATGPSSFNRLAYMLTVLSSFKIVIVSNDRGLLVLAVRLDYRDYAEKYKDLVPDNSKTADNATKNAEPLINLDVNNPDFKAGVMALANLLQIQRHDDYLVMLKAIRILVQERLTQDAVAKANQTKEGLPVALDKHILGFDTGGCSS

SEQ ID NO: 817012 - protein, 250 aa, Homo sapiens; identical to SEQ ID NO: 817010

SEQ ID NO: 817013 - protein, 242 aa, Homo sapiens
GFRTKARAGTAGRPFGGVAGACASRSTSLLLSRPRPGGPEREAGTMFRRKLTALDYHNPAGFNCKDETEFRNFIVWLEDQKIRHYKIEDRGNLRNIHSSDWPKFFEKYLRDVNCPFKIQDRQEAIDWLLGLAVRLEYGDNAEKYKDLVPDNSKTADNATKNAEPLINLDVNNPDFKAGVMALANLLQIQRHDDYLVMLKAIRILVQERLTQDAVAKANQTKEGLPVALDKHILGFDTGGCSS

SEQ ID NO: 817014 - protein, 250 aa, Homo sapiens; identical to SEQ ID NO: 817010

SEQ ID NO: 817015 - protein, 250 aa, Homo sapiens; identical to SEQ ID NO: 817010

SEQ ID NO: 817016 - protein, 250 aa, Homo sapiens; identical to SEQ ID NO: 817010

SEQ ID NO: 817017 - protein, 250 aa, Homo sapiens; identical to SEQ ID NO: 817010

SEQ ID NO: 817018 - protein, 170 aa, Homo sapiens
MSHVKPPVLKPKLALQVKQRIKNIPHHRLPQFFEKYLRDVNCPFKIQDRQEAIDWLLGLAVRLEYGDNAEKYKDLVPDNSKTADNATKNAEPLINLDVNNPDFKAGVMALANLLQIQRHDDYLVMLKAIRILVQERLTQDAVAKANQTKEGLPVALDKHILGFDTGGCSS

SEQ ID NO: 817019 - protein, 250 aa, Homo sapiens; identical to SEQ ID NO: 817010

SEQ ID NO: 817020 - protein, 131 aa, Homo sapiens
MGKSEDEHLRTSASTYLVQLGTFTSGGDNAEKYKDLVPDNSKTADNATKNAEPLINLDVNNPDFKAGVMALANLLQIQRHDDYLVMLKAIRILVQERLTQDAVAKANQTKEGLPVALDKHILGFDTGGCSS

SEQ ID NO: 817021 - protein, 109 aa, Homo sapiens
IFLPVFIAEKYKDLVPDNSKTADNATKNAEPLINLDVNNPDFKAGVMALANLLQIQRHDDYLVMLKAIRILVQERLTQDAVAKANQTKEGLPVALDKHILGFDTGGCSS

SEQ ID NO: 817022 - protein, 336 aa, Homo sapiens
GHRFNHDWRSAVISERLSACPPSRRVAGACASRSTSLLLSRPRPGGPEREAGTMFRRKLTALDYHNPAGFNCKDETEFRNFIVWLEDQKIRHYKIEDRGNLRNIHSSDWPKFFEKYLRDVNCPFKIQDRQEAIDWLLGLAVRLEYGDNAEKYKDLVPDNSKTADNATKNAEPLINLDVNNPDFKAGVMALANLLQIQRHDDYLVMLKAIRILVQERLTQDAVAKANQTKEGLPVALDKHILGFDTGASHLRPLRAHPVISQFIRGTRQARQPVAPKGRQDPQAPSSEGWKGWQIASLIHLHRSRFLMLSPDLVSHHARSQGTRPEIVFFLSFLASG

SEQ ID NO: 817023 - protein, 281 aa, Homo sapiens
GHRFNHDWRSAVISERLSACPPSRRVAGACASRSTSLLLSRPRPGGPEREAGTMFRRKLTALDYHNPAGFNCKDETEFRNFIVWLEDQKIRHYKIEDRGNLRNIHSSDWPKFFEKYLRDVNCPFKIQDRQEAIDWLLGLAVRLEYGDNAEKYKDLVPDNSKTADNATKNAEPLINLDVNNPDFKAGVMALANLLQIQRHDDYLVMLKAIRILVQERLTQDAVAKANQTKEDAVLNEAAQILRLLHIEELRELQTKINEAIVAVQAIIADPKTDHRLGKVGR

SEQ ID NO: 817024 - protein, 217 aa, Homo sapiens
GHRFNHDWRSAVISERLSACPPSRRVAGACASRSTSLLLSRPRPGGPEREAGTMFRRKLTALDYHNPAGFNCKDETEFRNFIVWLEDQKIRHYKIEDRGNLRNIHSSDWPKFFEKYLRDVNCPFKIQDRQEAIDWLLGLAVRLEYGDNAEKYKDLVPDNSKTADNATKNAEPLINLDVNNPDFKAGVMALANLLQIQRHDDYLVMLKAIRILVQGSC

SEQ ID NO: 817025 - protein, 473 aa, Homo sapiens
GAAPGSVCLCQCVCPSLLHCLPPLLLLLLLPLLLHESSQPPALRVVATSSDRNFMNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKADVLSEEAILKWYKEAHVAKGKSVFLDQMKKFVEWLQNAEEESESEGEEN

SEQ ID NO: 817026 - protein, 473 aa, Homo sapiens; identical to SEQ ID NO: 817025

SEQ ID NO: 817027 - protein, 473 aa, Homo sapiens; identical to SEQ ID NO: 817025

SEQ ID NO: 817028 - protein, 224 aa, Homo sapiens
GAAPGSVCLCQCVCPSLLHCLPPLLLLLLLPLLLHESSQPPALRVVATSSDRNFMNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKPFPKQSRQSWRCCRGFCWAMAPCPPPSSPVSSPTA

SEQ ID NO: 817029 - protein, 267 aa, Homo sapiens
MLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKADVLSEEAILKWYKEAHVAKGKSVFLDQMKKFVEWLQNAEEESESEGEEN

SEQ ID NO: 817030 - protein, 215 aa, Homo sapiens
GAAPGSVCLCQCVCPSLLHCLPPLLLLLLLPLLLHESSQPPALRVVATSSDRNFMNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKALRPHLLSSFSKHGWQKKMPTLLPRL

SEQ ID NO: 817031 - protein, 255 aa, Homo sapiens
GAAPGSVCLCQCVCPSLLHCLPPLLLLLLLPLLLHESSQPPALRVVATSSDRNFMNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGNEAPVFSPVRQQKKNKVTDS

SEQ ID NO: 817032 - protein, 169 aa, Homo sapiens
GAAPGSVCLCQCVCPSLLHCLPPLLLLLLLPLLLHESSQPPALRVVATSSDRNFMNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQLQ

SEQ ID NO: 817033 - protein, 216 aa, Homo sapiens
DRSSHSLVGTTRRNFMNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGNEAPVFSPVRQQKKNKVTDS

SEQ ID NO: 817034 - protein, 473 aa, Homo sapiens; identical to SEQ ID NO: 817025

SEQ ID NO: 817035 - protein, 473 aa, Homo sapiens; identical to SEQ ID NO: 817025

SEQ ID NO: 817036 - protein, 434 aa, Homo sapiens
DRSSHSLVGTTRRNFMNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKADVLSEEAILKWYKEAHVAKGKSVFLDQMKKFVEWLQNAEEESESEGEEN

SEQ ID NO: 817037 - protein, 321 aa, Homo sapiens
MQTHSSISWWLAVCLVFNKLIRRYKYLEKAFEDEMKKLLLFLKAFSETEQTKLAMLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKADVLSEEAILKWYKEAHVAKGKSVFLDQMKKFVEWLQNAEEESESEGEEN

SEQ ID NO: 817038 - protein, 455 aa, Homo sapiens
GAAPGSVCLCQCVCPSLLHCLPPLLLLLLLPLLLHESSQPPALRVVATSSDRNFMNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKADVLSEEAILKWYKEAHVAKGKSVFLDQMKKFVEWLQNAEEESESEGEEN

SEQ ID NO: 817039 - protein, 445 aa, Homo sapiens
GAAPGSVCLCQCVCPSLLHCLPPLLLLLLLPLLLHESSQPPALRVVATSSDRNFMNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKVSIASSLRTSALVPIRHERHEP

SEQ ID NO: 817040 - protein, 257 aa, Homo sapiens
RDRALYDGVALRQYRRRKMAATLLAARGAGPAPAWGPEAFTPDWESREVSTGTTIMAVQFDGGVVLGADSRTTTGSYIANRVTDKLTPIHDRIFCCRSGSAADTQAVADAVTYQLGFHSIELNEPPLVHTAASLFKEMCYRYREDLMAGIIIAGWDPQEGGQVYSVPMGGMMVRQSFAIGGSGSSYIYGYVDATYREGMTKEECLQFTANALALAMERDGSSGGVIRLAAIAESGVERQVLLGDQIPKFAVATLPPA

SEQ ID NO: 817041 - protein, 257 aa, Homo sapiens; identical to SEQ ID NO: 817040

SEQ ID NO: 817042 - protein, 176 aa, Homo sapiens
MRPWVFYFSITFLGQKFFAKFFGQGFPKKVFFKLNNLKPPPQKKKPKDTAASLFKEMCYRYREDLMAGIIIAGWDPQEGGQVYSVPMGGMMVRQSFAIGGSGSSYIYGYVDATYREGMTKEECLQFTANALALAMERDGSSGGVIRLAAIAESGVERQVLLGDQIPKFAVATLPPA

SEQ ID NO: 817043 - protein, 114 aa, Homo sapiens [sequence omitted]

SEQ ID NO: 817044 - protein, 250 aa, Homo sapiens
IRGRVDTTEGKMAATLLAARGAGPAPAWGPEAFTPDWESREVSTGTTIMAVQFDGGVVLGADSRTTTGSYIANRVTDKLTPIHDRIFCCRSGSAADTQAVADAVTYQLGFHSIELNEPPLVHTAASLFKEMCYRYREDLMAGIIIAGWDPQEGGQVYSVPMGGMMVRQSFAIGGSGSSYIYGYVDATYREGMTKEECLQFTANALALAMERDGSSGGVIRLAAIAESGVERQVLLGDQIPKFAVATLPPA

SEQ ID NO: 817045 - protein, 257 aa, Homo sapiens; identical to SEQ ID NO: 817040

SEQ ID NO: 817046 - protein, 256 aa, Homo sapiens
RDRALYDGVALRQYRRRKMAATLLAARGAGPAPAWGPEAFTPDWESREVSTGTTIMAVQFDGGVVLGADSRTTTGSYIANRVTDKLTPIHDRIFCCRSGSAADTQAVADAVTYQLGFHSIELNEPPLVHTAASLFKEMCYRYREDLMAGIIIAGWDPQEGGQVYSVPMGGMMVRQSFAIGGSGSSYIYGYVDATYREGMTKEECLQFTANALALAMERDGSSGGVIRLAAIAESGVERQVLLGDQIPKFAVATLHR

SEQ ID NO: 817047 - protein, 179 aa, Homo sapiens
IPCHRGLPGSSVNEFLKKCLLWTSGGQAVADAVTYQLGFHSIELNEPPLVHTAASLFKEMCYRYREDLMAGIIIAGWDPQEGGQVYSVPMGGMMVRQSFAIGGSGSSYIYGYVDATYREGMTKEECLQFTANALALAMERDGSSGGVIRLAAIAESGVERQVLLGDQIPKFAVATLPPA

SEQ ID NO: 817048 - protein, 139 aa, Homo sapiens
MLSPTSSVSTDTAASLFKEMCYRYREDLMAGIIIAGWDPQEGGQVYSVPMGGMMVRQSFAIGGSGSSYIYGYVDATYREGMTKEECLQFTANALALAMERDGSSGGVIRLAAIAESGVERQVLLGDQIPKFAVATLPPA

SEQ ID NO: 817049 - protein, 257 aa, Homo sapiens; identical to SEQ ID NO: 817040

SEQ ID NO: 817050 - protein, 256 aa, Homo sapiens
CNECGKTFCQKLHLTQHLRTHSGEKPYECSECGKTFCQKTHLTLHQRNHSGERPYPCNECGKSFSRKSALSDHQRTHTGEKLYKCNECGKSYYRKSTLITHQRTHTGEKPYQCSECGKFFSRVSYLTIHYRSHLEEKPYECNECGKTFNLNSAFIRHRKVHTEEKSHECSECGKFSQLYLTDHHTAHLEEKPYECNECGKTFLVNSAFDGHQPLPKGEKSYECNECGKKFHHRSAFNSHQRIHRRGNMNVLDVENL

SEQ ID NO: 817051 - protein, 396 aa, Homo sapiens
CNECGKTFCQKLHLTQHLRTHSGEKPYECSECGKTFCQKTHLTLHQRNHSGERPYPCNECGKSFSRKSALSDHQRTHTGEKLYKCNECGKSYYRKSTLITHQRTHTGEKPYQCSECGKFFSRVSYLTIHYRSHLEEKPYECNECGKTFNLNSAFIRHRKVHTEEKSHECSECGKFSQLYLTDHHTAHLEEKPYECNECGKTFLVNSAFDGHQPLPKGEKSYECNVCGKLFNELSYYTEHYRSHSEEKPYGCSECGKTFSHNSSLFRHQRVHTGEKPYECYECGKFFSQKSYLTIHHRIHSGEKPYECSKCGKVFSRMSNLTVHYRSHSGEKPYECNECGKVFSQKSYLTVHYRTHSGEKPYECNECGKKFHHRSAFNSHQRIHRRGNMNVLDVENL

SEQ ID NO: 817052 - protein, 128 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQVISKTQNTHKKQNCASSLLNQISK

SEQ ID NO: 817053 - protein, 242 aa, Homo sapiens
MTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQRVRNKYTQ

SEQ ID NO: 817054 - protein, 135 aa, Homo sapiens
AGDLEDPIHSTCWLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTAAR

SEQ ID NO: 817055 - protein, 1045 aa, Homo sapiens
RLARAAAAAEGGAKLKMADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 817056 - protein, 1045 aa, Homo sapiens; identical to SEQ ID NO: 817055

SEQ ID NO: 817057 - protein, 1045 aa, Homo sapiens; identical to SEQ ID NO: 817055

SEQ ID NO: 817058 - protein, 298 aa, Homo sapiens
MNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIGLHVF

SEQ ID NO: 817059 - protein, 1031 aa, Homo sapiens
LGAGWVAAGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 817060 - protein, 1027 aa, Homo sapiens
RLARAAAAAEGGAKLKMADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 817061 - protein, 1005 aa, Homo sapiens
MFFFSCMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 817062 - protein, 287 aa, Homo sapiens
MDKPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIGLHVF

SEQ ID NO: 817063 - protein, 941 aa, Homo sapiens
MSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 817064 - protein, 785 aa, Homo sapiens
MDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 817065 - protein, 281 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIGLHVF

SEQ ID NO: 817066 - protein, 785 aa, Homo sapiens; identical to SEQ ID NO: 817064

SEQ ID NO: 817067 - protein, 596 aa, Homo sapiens
MIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 817068 - protein, 596 aa, Homo sapiens; identical to SEQ ID NO: 817067

SEQ ID NO: 817069 - protein, 986 aa, Homo sapiens
RLARAAAAAEGGAKLKMADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERSPSGSRTPKRSRRSRSRSPKKSGKKSRSQSRSPHRSHKKSKKNKH

SEQ ID NO: 817070 - protein, 342 aa, Homo sapiens
MDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 817071 - protein, 305 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIGLHVF

SEQ ID NO: 817072 - protein, 1045 aa, Homo sapiens; identical to SEQ ID NO: 817055

SEQ ID NO: 817073 - protein, 301 aa, Homo sapiens
MKEHERREYLKTLNEEEEKEEESEFEEMKKKMKITLKLITQEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 817074 - protein, 206 aa, Homo sapiens
MVLDIGVEGGGGLAGDDSLNFPPLQLKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 817075 - protein, 1045 aa, Homo sapiens; identical to SEQ ID NO: 817055

SEQ ID NO: 817076 - protein, 126 aa, Homo sapiens
GRYHPSLSCCFREIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIGLHVF

SEQ ID NO: 817077 - protein, 986 aa, Homo sapiens; identical to SEQ ID NO: 817069

SEQ ID NO: 817078 - protein, 908 aa, Homo sapiens
RLARAAAAAEGGAKLKMADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQRVRNKYTQ

SEQ ID NO: 817079 - protein, 850 aa, Homo sapiens
RLARAAAAAEGGAKLKMADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTEVPPNRPR

SEQ ID NO: 817080 - protein, 320 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIVVSLFLLILIIDAFSRFILK

SEQ ID NO: 817081 - protein, 428 aa, Homo sapiens
RLARAAAAAEGGAKLKMADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKVI

SEQ ID NO: 817082 - protein, 203 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEVCDQLPGHFVK

SEQ ID NO: 817083 - protein, 321 aa, Homo sapiens
RLARAAAAAEGGAKLKMADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEECCAKNSEIGRYQGEIMG

SEQ ID NO: 817084 - protein, 239 aa, Homo sapiens
MLLTRKQTCQLGILLSIHRQHSKIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIVVSLFLLILIIDAFSRFILK

SEQ ID NO: 817085 - protein, 210 aa, Homo sapiens
RLARAAAAAEGGAKLKMADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPVSHT

SEQ ID NO: 817086 - protein, 241 aa, Homo sapiens
TRPCCCRRRRRGKAQDGGQNARRISEGQFKDSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIESSSLVSMDVRLAHLQYINERR

SEQ ID NO: 817087 - protein, 305 aa, Homo sapiens; identical to SEQ ID NO: 817071

SEQ ID NO: 817088 - protein, 128 aa, Homo sapiens; identical to SEQ ID NO: 817052

SEQ ID NO: 817089 - protein, 1045 aa, Homo sapiens; identical to SEQ ID NO: 817055

SEQ ID NO: 817090 - protein, 1045 aa, Homo sapiens; identical to SEQ ID NO: 817055

SEQ ID NO: 817091 - protein, 305 aa, Homo sapiens; identical to SEQ ID NO: 817071

SEQ ID NO: 817092 - protein, 331 aa, Homo sapiens
TRPCCCRRRRRGKAQDGGQNARRISEGQFKDSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIGLHVF

SEQ ID NO: 817093 - protein, 1021 aa, Homo sapiens
TTNLYLGNINPQMNEEMLCQEFGRFGPLASVKIMWPRTDEERARERNCGFVAFMNRRDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 817094 - protein, 224 aa, Homo sapiens
MLLTRKQTCQLGILLSIHRQHSKIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIGLHVF

SEQ ID NO: 817095 - protein, 826 aa, Homo sapiens
RLARAAAAAEGGAKLKMADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPLLQLLNGNYLTSMKNQKKKKIKIKKKKVKMKKILKVPNLKNIICTLIQSKKK

SEQ ID NO: 817096 - protein, 224 aa, Homo sapiens; identical to SEQ ID NO: 817094

SEQ ID NO: 817097 - protein, 596 aa, Homo sapiens; identical to SEQ ID NO: 817067

SEQ ID NO: 817098 - protein, 941 aa, Homo sapiens
RLARAAAAAEGGAKLKMADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKDPAHLAVAVVDE

SEQ ID NO: 817099 - protein, 305 aa, Homo sapiens; identical to SEQ ID NO: 817071

SEQ ID NO: 817100 - protein, 305 aa, Homo sapiens; identical to SEQ ID NO: 817071

SEQ ID NO: 817101 - protein, 1045 aa, Homo sapiens; identical to SEQ ID NO: 817055

SEQ ID NO: 817102 - protein, 283 aa, Homo sapiens
MDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERSPSGSRTPKRSRRSRSRSPKKSGKKSRSQSRSPHRSHKKSKKNKH

SEQ ID NO: 817103 - protein, 147 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEDRNPSSSWCTNRLCYSDLAPMSTKVYNSK

SEQ ID NO: 817104 - protein, 134 aa, Homo sapiens
ICNDSLNLHGYKLKVMKFQDELESGKRPKKPGQSFQEQVEHYRDKLLQREKEKELERERERDKKDKEKLESRSKDKKEKDECTPTRKERSPSGSRTPKRSRRSRSRSPKKSGKKSRSQSRSPHRSHKKSKKNKH

SEQ ID NO: 817105 - protein, 311 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTAAR

SEQ ID NO: 817106 - protein, 318 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMLKRKHWQRVEWGTEL

SEQ ID NO: 817107 - protein, 260 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEVRDVIMFIRFAFLI

SEQ ID NO: 817108 - protein, 215 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIESSSLVSMDVRLAHLQYINERR

SEQ ID NO: 817109 - protein, 203 aa, Homo sapiens; identical to SEQ ID NO: 817082

SEQ ID NO: 817110 - protein, 122 aa, Homo sapiens
MLLTRKQTCQLGILLSIHRQHSKIDQILIHQQIELLEVLTGFETNNKYEIKNSFGQRVYFAAEDTDCCTRNCCGPSRPFTLRIIDNMGQEVITLERPLRCSSCCCPCCLQEVCDQLPGHFVK

SEQ ID NO: 817111 - protein, 316 aa, Homo sapiens
MAEVKVKVQPPDADPVEIENRIIELCHQFPHGITDQVIQNEMPHIEAQQRAVAINRLLSMGQLDLLRSNTGLLYRIKDSQNAGKMKGSDNQEKLVYQIIEDAGNKGIWSRDIRYKSNLPLTEINKILKNLESKKLIKAVKSVAASKKKVYMLYNLQPDRSVTGGAWYSDQDFESEFVEVLNQQCFKFLQSKAETARESKQNPMIQRNSSFASSHEVWKYICELGISKVELSMEDIETILNTLIYDGKVEMTIIAAKEGTVGSVDGHMKLYRAVNPIIPPTGLVRAPCGLCPVFDDCHEGGEISPSNCIYMTEWLEF

SEQ ID NO: 817112 - protein, 316 aa, Homo sapiens; identical to SEQ ID NO: 817111

SEQ ID NO: 817113 - protein, 216 aa, Homo sapiens
MAEVKVKVQPPDADPVEIENRIIELCHQFPHGITDQVIQNEMPHIEAQQRAVAINRLLSMGQLDLLRSNTGLLYRIKDSQNAGKMKGSDNQEKLVYQIIEDAGNKGIWSRDIRYKSNLPLTEINKILKNLESKKLIKAVKSVAPLRLDSDHDFESAFVEGLNHSVEILQPSGTERSNDHVKKAPPEGHCRAQEVRDRPEPWEGNWQRGTATRGAAA

SEQ ID NO: 817114 - protein, 168 aa, Homo sapiens
MKGSDNQEKLVYQIIEDAGNKGIWSRDIRYKSNLPLTEINKILKNLESKKLIKAVKSVAASKKKVYMLYNLQPDRSVTGGAWYSDQDFESEFVEVLNQQCFKFLQSKAETARESKQNPMIQRNSSFASSHEVWKYICELGISKVFDDCHEGGEISPSNCIYMTEWLEF

SEQ ID NO: 817115 - protein, 265 aa, Homo sapiens
MAEVKVKVQPPDADPVEIENRIIELCHQFPHGITDQVIQNEMPHIEAQQRAVAINRLLSMGQLDLLRSNTGLLYRIKDSQNAGKMKGSDNQEKLVYQIIEDAGNKGIWSRDIRYKSNLPLTEINKILKNLESKKLIKAVKSVAASKKKVYMLYNLQPDRSVTGGAWYSDQDFESEFVEVLNQQCFKFLQSKAETARESKQNPMIQRNSSFASSHEVWKYICELGISKVELSMEDIETILNTLIYDGKVEMTIIAAKEGTVGSVDG

SEQ ID NO: 817116 - protein, 222 aa, Homo sapiens
MAEVKVKVQPPDADPVEIENRIIELCHQFPHGITDQVIQNEMPHIEAQQRAVAINRLLSMGQLDLLRSNTGLLYRIKDSQNAGKMKGSDNQEKLVYQIIEDAGNKGIWSRDIRYKSNLPLTEINKILKNLESKKLIKAVKSVAASKKKVYMLYNLQPDRSVTGGAWYSDQDFESEFVEVLNQQCFKFLQSKRTAEKRTSPIRTPHHGKGLAHGVTGTRGAPG

SEQ ID NO: 817117 - protein, 296 aa, Homo sapiens
MAEVKVKVQPPDADPVEIENRIIELCHQFPHGITDQVIQNEMPHIEAQQRAVAINRLLSMGQLDLLRSNTGLLYRIKDSQNAGKMKGSDNQEKLVYQIIEDAGNKGIWSRDIRYKSNLPLTEINKILKNLESKKLIKAVKSVAGAWYSDQDFESEFVEVLNQQCFKFLQSKAETARESKQNPMIQRNSSFASSHEVWKYICELGISKVELSMEDIETILNTLIYDGKVEMTIIAAKEGTVGSVDGHMKLYRAVNPIIPPTGLVRAPCGLCPVFDDCHEGGEISPSNCIYMTEWLEF

SEQ ID NO: 817118 - protein, 727 aa, Homo sapiens
MNQKLLKLENLLRFHTIYRQLHSLCQRRALRQWRHGFSSAYPVWTAQLCAWPWPTDVLNGAALSQYRLLVTKKEEGPWKSQLSSTKSKKVVEVWIGMTIEELARAMEKNTDYVYEALLNTDIDIDSLEADSHLDEVWIKEVITKAGMKLKWSKLKQDKVRKNKDAVRRPQADPALLTPRSPVVTIMGHVDHGKTTLLDKFRKTQVAAVETGGITQHIGAFLVSLPSGEKITFLDTPGHAAFSAMRARGAQVTDIVVLVVAADDGVMKQTVESIQHAKDAQVPIILAVNKCDKAEADPEKVKKELLAYDVVCEDYGGDVQAVPVSALTGDNLMALAEATVALAEMLELKADPNGPVEGTVIESFTDKGRGLVTTAIIQRGTLRKGSVLVAGKCWAKVRLMFDENGKTIDEAYPSMPVGITGWRDLPSAGEEILEVESEPRAREVVDWRKYEQEQEKGQEDLKIIEEKRKEHKEAHQKAREKYGHLLWKKRSILRFLERKEQIPLKPKEKRERDSNVLSVIIKGDVDGSVEAILNIIDTYDASHECELELVHFGVGDISANDVNLAETFDGVIYGFNVNAGNVIQQSAAKKGVKIKLHKIIYRLVEDLQEELSSRLPCAVEEHPVGEASILATFSVTEGKKKVPVAGCRVQKGQLEKQKKFKLTRNGHVIWKGSLTSLKHHKDDISIVKTGMDCGLSLDEDNMEFQVGDRIVCYEEKQIQAKTSWDPGF

SEQ ID NO: 817119 - protein, 727 aa, Homo sapiens; identical to SEQ ID NO: 817118

SEQ ID NO: 817120 - protein, 441 aa, Homo sapiens
MNQKLLKLENLLRFHTIYRQLHSLCQRRALRQWRHGFSSAYPVWTAQLCAWPWPTDVLNGAALSQYRLLVTKKEEGPWKSQLSSTKSKKVVEVWIGMTIEELARAMEKNTDYVYEALLNTDIDIDSLEADSHLDEVWIKEVITKAGMKLKWSKLKQDKVRKNKDAVRRPQADPALLTPRSPVVTIMGHVDHGKTTLLDKFRKTQVAAVETGGITQHIGAFLVSLPSGEKITFLDTPGHAAFSAMRARGAQVTDIVVLVVAADDGVMKQTVESIQHAKDAQVPIILAVNKCDKAEADPEKVKKELLAYDVVCEDYGGDVQAVPVSALTGDNLMALAEATVALAEMLELKADPNGPVEGTVIESFTDKGRGLVTTAIIQRGTLRKGSVLVAGKCWAKVRLMFDENGKTIDEAYPSMPVGITGWRDLPSAGEEILEVESEVYQA

SEQ ID NO: 817121 - protein, 727 aa, Homo sapiens; identical to SEQ ID NO: 817118

SEQ ID NO: 817122 - protein, 631 aa, Homo sapiens
MTIEELARAMEKNTDYVYEALLNTDIDIDSLEADSHLDEVWIKEVITKAGMKLKWSKLKQDKVRKNKDAVRRPQADPALLTPRSPVVTIMGHVDHGKTTLLDKFRKTQVAAVETGGITQHIGAFLVSLPSGEKITFLDTPGHAAFSAMRARGAQVTDIVVLVVAADDGVMKQTVESIQHAKDAQVPIILAVNKCDKAEADPEKVKKELLAYDVVCEDYGGDVQAVPVSALTGDNLMALAEATVALAEMLELKADPNGPVEGTVIESFTDKGRGLVTTAIIQRGTLRKGSVLVAGKCWAKVRLMFDENGKTIDEAYPSMPVGITGWRDLPSAGEEILEVESEPRAREVVDWRKYEQEQEKGQEDLKIIEEKRKEHKEAHQKAREKYGHLLWKKRSILRFLERKEQIPLKPKEKRERDSNVLSVIIKGDVDGSVEAILNIIDTYDASHECELELVHFGVGDISANDVNLAETFDGVIYGFNVNAGNVIQQSAAKKGVKIKLHKIIYRLVEDLQEELSSRLPCAVEEHPVGEASILATFSVTEGKKKVPVAGCRVQKGQLEKQKKFKLTRNGHVIWKGSLTSLKHHKDDISIVKTGMDCGLSLDEDNMEFQVGDRIVCYEEKQIQAKTSWDPGF

SEQ ID NO: 817123 - protein, 484 aa, Homo sapiens [sequence omitted]

SEQ ID NO: 817124 - protein, 742 aa, Homo sapiens
MNQKLLKLENLLRFHTIYRQLHSLCQRRALRQWRHGFSSAYPVWTAQLCAWPWPTDVLNGAALSQYRLLVTKKEEGPWKSQLSSTKSKKVVEVWIGMTIEELARAMEKNTDYVYEALLNTDIDIDSLEADSHLDEVWIKEVITKAGMKLKWSKLKQDKVRKNKDAVRRPQADPALLTPRSPVVTIMGHVDHGKTTLLDKFRKTQVAAVETGGITQHIGAFLVSLPSGEKITFLDTPGHAAFSAMRARGAQVTDIVVLVVAADDGVMKQTVESIQHAKDAQVPIILAVNKCDKAEADPEKVKKELLAYDVVCEDYGGDVQAVPVSALTGDNLMALAEATVALAEMLELKADPNGPVEGTVIESFTDKGRGLVTTAIIQRGTLRKGSVLVAGKCWAKVRLMFDENGKTIDEAYPSMPVGITGWRDLPSAGEEILEVESEPRAREVVDWRKYEQEQEKGQEDLKIIEEKRKEHKEAHQKAREKYGHLLWKKRSILRFLERKEQIPLKPKEKRERDSNVLSVIIKGDVDGSVEAILNIIDTYDASHECELELVHFGVGDISANDVNLAETFDGVIYGFNVNAGNVIQQSAAKKGVKIKLHKIIYRLVEDLQEELSSRLPCAVEEHPVGEASILATFSVTEGKKKVPVAGCRVQKGQLEKQKKFKLTRNGHVIWKGSLTSLKHHKDDISIVKTGMDCGLSLDEDNMDSGGTEMCVTKAIQQILVRLQSYMFSKKRGANTGALALVKA

SEQ ID NO: 817125 - protein, 492 aa, Homo sapiens
MNQKLLKLENLLRFHTIYRQLHSLCQRRALRQWRHGFSSAYPVWTAQLCAWPWPTDVLNGAALSQYRLLVTKKEEGPWKSQLSSTKSKKVVEVWIGMTIEELARAMEKNTDYVYEALLNTDIDIDSLEADSHLDEVWIKEVITKAGMKLKWSKLKQDKVRKNKDAVRRPQADPALLTPRSPVVTIMGHVDHGKTTLLDKFRKTQVAAVETGGITQHIGAFLVSLPSGEKITFLDTPGHAAFSAMRARGAQVTDIVVLVVAADDGVMKQTVESIQHAKDAQVPIILAVNKCDKAEADPEKVKKELLAYDVVCEDYGGDVQAVPVSALTGDNLMALAEATVALAEMLELKADPNGPVEGTVIESFTDKGRGLVTTAIIQRGTLRKGSVLVAGKCWAKVRLMFDENGKTIDEAYPSMPVGITGWRDLPSAGEEILEVESEPRAREVVDWRKYEQEQEKGQEDLIWRKEGTKSLRSRKVGPTGGEISGRERTSSRK

SEQ ID NO: 817126 - protein, 348 aa, Homo sapiens
MNQKLLKLENLLRFHTIYRQLHSLCQRRALRQWRHGFSSAYPVWTAQLCAWPWPTDVLNGAALSQYRLLVTKKEEGPWKSQLSSTKSKKVVEVWIGMTIEELARAMEKNTDYVYEALLNTDIDIDSLEADSHLDEVWIKEVITKAGMKLKWSKLKQDKVRKNKDAVRRPQADPALLTPRSPVVTIMGHVDHGKTTLLDKFRKTQVAAVETGGITQHIGAFLVSLPSGEKITFLDTPGHAAFSAMRARGAQVTDIVVLVVAADDGVMKQTVESIQHAKDAQVPIILAVNKCDKAEADPEKKKKKKKKKTPFGAPLTPQRKVFKPNAFGRPRRPRGGGDTAGPKPGSQGN

SEQ ID NO: 817127 - protein, 727 aa, Homo sapiens; identical to SEQ ID NO: 817118

SEQ ID NO: 817128 - protein, 727 aa, Homo sapiens; identical to SEQ ID NO: 817118

SEQ ID NO: 817129 - protein, 727 aa, Homo sapiens; identical to SEQ ID NO: 817118

SEQ ID NO: 817130 - protein, 484 aa, Homo sapiens [sequence omitted]

SEQ ID NO: 817131 - protein, 727 aa, Homo sapiens; identical to SEQ ID NO: 817118

SEQ ID NO: 817132 - protein, 727 aa, Homo sapiens; identical to SEQ ID NO: 817118

SEQ ID NO: 817133 - protein, 409 aa, Homo sapiens
MNQKLLKLENLLRFHTIYRQLHSLCQRRALRQWRHGFSSAYPVWTAQLCAWPWPTDVLNGAALSQYRLLVTKKEEGPWKSQLSSTKSKKVVEVWIGMTIEELARAMEKNTDYVYEALLNTDIDIDSLEADSHLDEVWIKEVITKAGMKLKWSKLKQDKVRKNKDAVRRPQADPALLTPRSPVVTIMGHVDHGKTTLLDKFRKTQVAAVETGGITQHIGAFLVSLPSGEKITFLDTPGHAAFSAMRARGAQVTDIVVLVVAADDGVMKQTVESIQHAKDAQVPIILAVNKCDKAEADPEKVKKELLAYDVVCEDYGGDVQAVPVSALTGDNLMALAEATVALAEMLELKADPNGPVEGTVIESFTDKGRGLVTTAIIQRGTLRKGSVLVAGKCWAKVRLMFDVEPSFCRR

SEQ ID NO: 817134 - protein, 529 aa, Homo sapiens
MGCVFCKKLEPVATAKEDAGLEGDFRSYGAADHYGPDPTKARPASSFAHIPNYSNFSSQAINPGFLDSGTIRGVSGIGVTLFIALYDYEARTEDDLTFTKGEKFHILNNTEGDWWEARSLSSGKTGCIPSNYVAPVDSIQAEEWYFGKIGRKDAERQLLSPGNPQGAFLIRESETTKGAYSLSIRDWDQTRGDHVKHYKIRKLDMGGYYITTRVQFNSVQELVQHYMEVNDGLCNLLIAPCTIMKPQTLGLAKDAWEISRSSITLERRLGTGCFGDVWLGTWNGSTKVAVKTLKPGTMSPKAFLEEAQVMKLLRHDKLVQLYAVVSEEPIYIVTEFMCHGSLLDFLKNPEGQDLRLPQLVDMAAQVAEGMAYMERMNYIHRDLRAANILVGERLACKIADFGLARLIKDDEYNPCQGSKFPIKWTAPEAALFGRFTIKSDVWSFGILLTELITKGRIPYPGMNKREVLEQVEQGYHMPCPPGCPASLYEAMEQTWRLDPEERPTFEYLQSFLEDYFTSAEPQYQPGDQT

SEQ ID NO: 817135 - protein, 529 aa, Homo sapiens; identical to SEQ ID NO: 817134

SEQ ID NO: 817136 - protein, 529 aa, Homo sapiens; identical to SEQ ID NO: 817134

SEQ ID NO: 817137 - protein, 529 aa, Homo sapiens; identical to SEQ ID NO: 817134

SEQ ID NO: 817138 - protein, 432 aa, Homo sapiens
MGCVFCKKLEPVATAKEDAGLEGDFRSYGAADHYGPDPTKARPASSFAHIPNYSNFSSQAINPGFLDSGTIRGVSGIGVTLFIALYDYEARTEDDLTFTKGEKFHILNNTEGDWWEARSLSSGKTGCIPSNYVAPVDSIQAEEWYFGKIGRKDAERQLLSPGNPQGAFLIRESETTKGAYSLSIRDWDQTRGDHVKHYKIRKLDMGGYYITTRVQFNSVQELVQHYMEVNDGLCNLLIAPCTIMKPQTLGLAKDAWEISRSSITLERRLGTGCFGDVWLGTWNGSTKVAVKTLKPGTMSPKAFLEEAQVMKLLRHDKLVQLYAVVSEEPIYIVTEFMCHGSLLDFLKNPEGQDLRLPQLVDMAAQVAEGMAYMERMNYIHRDLRAANILVGERLACKIADFGLARLIKDDEYNPCQGSKFPIKWTAPEAVGA

SEQ ID NO: 817139 - protein, 297 aa, Homo sapiens [sequence omitted]

SEQ ID NO: 817140 - protein, 121 aa, Homo sapiens
MGCVFCKKLEPVATAKEDAGLEGDFRSYGAADHYGPDPTKARPASSFAHIPNYSNFSSQAINPGFLDSGTIRGVSGESKGSEAGAAWILGETEGRRRDANLPLGASRRMWQIQPRFQDHMG

SEQ ID NO: 817141 - protein, 554 aa, Homo sapiens
MGCVFCKKLEPVATAKEDAGLEGDFRSYGAADHYGPDPTKARPASSFAHIPNYSNFSSQAINPGFLDSGTIRGVSGIGVTLFIALYDYEARTEDDLTFTKGEKFHILNNTEGDWWEARSLSSGKTGCIPSNYVAPVDSIQAEEWYFGKIGRKDAERQLLSPGNPQGAFLIRESETTKGAYSLSIRDWDQTRGDHVKHYKIRKLDMGGYYITTRVQFNSVQELVQHYMEVNDGLCNLLIAPCTIMKPQTLGLAKDAWEISRSSITLERRLGTGCFGDVWLGTELPGAGTRAWARGRGSCQDSLRAGTWNGSTKVAVKTLKPGTMSPKAFLEEAQVMKLLRHDKLVQLYAVVSEEPIYIVTEFMCHGSLLDFLKNPEGQDLRLPQLVDMAAQVAEGMAYMERMNYIHRDLRAANILVGERLACKIADFGLARLIKDDEYNPCQGSKFPIKWTAPEAALFGRFTIKSDVWSFGILLTELITKGRIPYPGMNKREVLEQVEQGYHMPCPPGCPASLYEAMEQTWRLDPEERPTFEYLQSFLEDYFTSAEPQYQPGDQT

SEQ ID NO: 817142 - protein, 529 aa, Homo sapiens; identical to SEQ ID NO: 817134

SEQ ID NO: 817143 - protein, 898 aa, Homo sapiens
MRKGVLKDPEIADLFYKDDPEELFIGLHEIGHGSFGAVYFATNAHTSEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERPTSAELLRHDFVRRDRPLRVLIDLIQRTKDAVRELDNLQYRKMKKILFQETRNGPLNESQEDEEDSEHGTSLNREMDSLGSNHSIPSMSVSTGSQSSSVNSMQEVMDESSSELVMMHDDESTINSSSSVVHKKDHVFIRDEAGHGDPRPEPRPTQSVQSQALHYRNRERFATIKSASLVTRQIHEHEQENELREQMSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 817144 - protein, 898 aa, Homo sapiens
MRKGVLKDPEIADLFYKDDPEELFIGLHEIGHGSFGAVYFATNAHTNEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERPTSAELLRHDFVRRDRPLRVLIDLIQRTKDAVRELDNLQYRKMKKILFQETRNGPLNESQEDEEDSEHGTSLNREMDSLGSNHSIPSMSVSTGSQSSSVNSMQEVMDESSSELVMMHDDESTINSSSSVVHKKDHVFIRDEAGHGDPRPEPRPTQSVQSQALHYRNRERFATIKSASLVTRQIHEHEQENELREQMSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 817145 - protein, 898 aa, Homo sapiens; identical to SEQ ID NO: 817144

SEQ ID NO: 817146 - protein, 898 aa, Homo sapiens; identical to SEQ ID NO: 817144

SEQ ID NO: 817147 - protein, 833 aa, Homo sapiens
MRKGVLKDPEIADLFYKDDPEELFIGLHEIGHGSFGAVYFATNAHTNEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERPTSAELLRHDFVRRDRPLRVLIDLIQRTKDAVRELDNLQYRKMKKILFQETRNGPLNESQEDEEDSEHGTSLNREMDSLGSNHSIPSMSVSTGSQSSSVNSMQEVMDESSSELVMMHDDESTINSSSSVVHKKDHVFIRDEAGHGDPRPEPRPTQSVQSQALHYRNRERFATIKSASLVTRQIHEHEQENELREQMSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTESMSWNFGNSQKT

SEQ ID NO: 817148 - protein, 291 aa, Homo sapiens
MRKGVLKDPEIADLFYKDDPEELFIGLHEIGHGSFGAVYFATNAHTNEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERGKGKGEKRDTQIPEQCPVLGPIPPVK

SEQ ID NO: 817149 - protein, 146 aa, Homo sapiens [sequence omitted]

SEQ ID NO: 817150 - protein, 898 aa, Homo sapiens; identical to SEQ ID NO: 817143

SEQ ID NO: 817151 - protein, 898 aa, Homo sapiens; identical to SEQ ID NO: 817144

SEQ ID NO: 817152 - protein, 898 aa, Homo sapiens; identical to SEQ ID NO: 817144

SEQ ID NO: 817153 - protein, 898 aa, Homo sapiens; identical to SEQ ID NO: 817143

SEQ ID NO: 817154 - protein, 898 aa, Homo sapiens; identical to SEQ ID NO: 817143

SEQ ID NO: 817155 - protein, 438 aa, Homo sapiens
MSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 817156 - protein, 469 aa, Homo sapiens
MVLTHHTQKSISILVTRQIHEHEQENELREQMSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 817157 - protein, 379 aa, Homo sapiens
MRKGVLKDPEIADLFYKDDPEELFIGLHEIGHGSFGAVYFATNAHTNEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERPTSAELLRHDFVRRDRPLRVLIDLIQRTKDAVRELDNLQYRKMKKILFQETRNGPLNESQEDEEDSEHGTSLNREMDSLGSNHSIPSMSVSTGSQSSSVNSMQEVMDESSSELS

SEQ ID NO: 817158 - protein, 787 aa, Homo sapiens [sequence omitted]

SEQ ID NO: 817159 - protein, 129 aa, Homo sapiens
CRQGCMTVCVFCVLQLRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 817160 - protein, 704 aa, Homo sapiens
FSVVSSCLELLSWVSLLQEKLREHLAEKEKLNEERLEQEEKLKAKIRQLTEEKAALEEYITQERNRAKETLEEERKRMQELESLLAQQKKALAKSITQEKNRVKEALEEEQTRVQELEERLARQKEISESNIAYEKRKAKEAMEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQK

SEQ ID NO: 817161 - protein, 129 aa, Homo sapiens
APKGSSTIMGPTIPEPLGYRGVNHRASAAPSTCSGRRCLELKQTCPPRRALFLTGPGLSSLHLCWNLEQRPPRDSARWGTVAPKSCAPFSLRKWIFLNFQMLPVWNAVPGKAQRSKWLASKSGEKSIFL

SEQ ID NO: 817162 - protein, 521 aa, Homo sapiens [sequence omitted]

SEQ ID NO: 817163 - protein, 556 aa, Homo sapiens
MVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKESVEEHELRNAKESTPCNCAFKEKDRQALPHLPAV

SEQ ID NO: 817164 - protein, 129 aa, Homo sapiens; identical to SEQ ID NO: 817161

SEQ ID NO: 817165 - protein, 139 aa, Homo sapiens
FSVVSSCLELLSWVSLLQEKLREHLAEKEKLNEERLEQEEKLKAKIRQLTEEKAALEEYITQERNRAKETLEEERKRMQELESLLAQQKKALAKSITQEKNRVKEALEEEQTRVQELEERLARQKEVLESSIAHEKRKA

SEQ ID NO: 817166 - protein, 155 aa, Homo sapiens
PRVSNCKPNPREIASFRFWVTMTFKQAPKGSSTIMGPTIPEPLGYRGVNHRASAAPSTCSGRRCLELKQTCPPRRALFLTGPGLSSLHLCWNLEQRPPRDSARWGTVAPKSCAPFSLRKWIFLNFQMLPVWNAVPGKAQRSKWLASKSGEKSIFL

SEQ ID NO: 817167 - protein, 110 aa, Homo sapiens
MSGHVSMKYLSRQEREKVNQLRQRDLDLVFDKITQLKNQLGRKEELLRGYEKDVEQLRYLGTPMSPQKGPGLPSPGYTQASSRPLGLGQEDRDPRVEYLQCQKGTREGTD

SEQ ID NO: 817168 - protein, 105 aa, Homo sapiens
MENNVQKILLDAKPDLPTLSRIEILAVTKENSLCCDWHVERRGLRADTSFVPWHSHTCQWFGAGCCLYSLAGAPTIPVVQGLHRKVAFHLPTVWFRMVLTLGHVN

SEQ ID NO: 817169 - protein, 192 aa, Homo sapiens
MAGLLALLGPAGRVGARVRPRATWLLGATAPCAPPPLALALLPPRLDARLLRTARGDCRGHQDPSQATGTTGSSVSCTEEKKQSKSQQLKKIFQEYGTVGVSLHIGISLISLGIFYMVVSSGVDMPAILLKLGFKESLVQSKMAAGTSTFVVAYAIHKLFAPVRISITLVSVPLIVRYFRKVGFFKPPAAKP

SEQ ID NO: 817170 - protein, 104 aa, Homo sapiens
MAGLLALLGPAGRVGARVRPRATWLLGATAPCAPPPLALALLPPRLDARLLRTARGDCRGHQSDRWHTGLGDPLQSGTFLHTPCRLLMILQGPAQLFLPPGSPL

SEQ ID NO: 817171 - protein, 192 aa, Homo sapiens; identical to SEQ ID NO: 817169

SEQ ID NO: 817172 - protein, 192 aa, Homo sapiens; identical to SEQ ID NO: 817169

SEQ ID NO: 817173 - protein, 192 aa, Homo sapiens; identical to SEQ ID NO: 817169

SEQ ID NO: 817174 - protein, 261 aa, Homo sapiens
MKITNGRHGDSAGAEGTMENFTALFGAQADPPPPPTALGFGPGKPPPPPPPPAGGGPGTAPPPTAATAPPGADKSGAGCGPFYLMRELPGSTELTGSTNLITHYNLEQAYNKFCGKKVKEKLSNFLPDLPGMIDLPGSHDNSSLRSLIEKPPILSSSFNPITGTMLAGFRLHTGPLPEQCRLMHIQPPKKKNKHKHKQSRTQDPVPPETPSDSDHKKKKKKKEEDPERKRKKKEKKKKKNRHSPDHPGMGSSQASSSSSLR

SEQ ID NO: 817175 - protein, 203 aa, Homo sapiens
MKITNGRHGDSAGAEGTMENFTALFGAQADPPPPPTALGFGPGKPPPPPPPPAGGGPGTAPPPTAATAPPGADKSGAGCGPFYLMRELPGSTELTGSTNLITHYNLEQAYNKFCGKKLPEQCRLMHIQPPKKKNKHKHKQSRTQDPVPPETPSDSDHKKKKKKKEEDPERKRKKKEKKKKKNRHSPDHPGMGSSQASSSSSLR

SEQ ID NO: 817176 - protein, 216 aa, Homo sapiens
MKITNGRHGDSAGAEGTMENFTALFGAQADPPPPPTALGFGPGKPPPPPPPPAGGGPGTAPPPTAATAPPGADKSGAGCGPFYLMRELPGSTELTGSTNLITHYNLEQAYNKFCGKKVKEKLSNFLPDLPGMIDLPGSHDNSSLRSLIEKPPILSSSFNPITGTMLAGFRLHTGPLPEQCRLMHIQPPKKKNKHKHKQSRTQDPVPPGKKQFYSKQ

SEQ ID NO: 817177 - protein, 211 aa, Homo sapiens
MKITNGRHGDSAGAEGTMENFTALFGAQADPPPPPTALGFGPGKPPPPPPPPAGGGPGTAPPPTAATAPPGADKSGAGCGPFYLMRELPGSTELTGSTNLITHYNLEQAYNKFCGKKVKEKLSNFLPDLPGMIDLPGSHDNSSLRSLIEKPPILSSSFNPITGTMLAGFRLHTGPLPEQCRLMHIQPPKKKNKHKHKQSRTQDPVPPGKPS

SEQ ID NO: 817178 - protein, 805 aa, Homo sapiens
MAFSPWQILSPVQWAKWTWSAVRGGAAGEDEAGGPEGDPEEEDSQAETKSLSFSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDIKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 817179 - protein, 121 aa, Homo sapiens [sequence omitted]

SEQ ID NO: 817180 - protein, 138 aa, Homo sapiens
RGAMALQLWALTCLGLLGAGASLRPRKLDFFRSEKELNHLAVDEASGVVYLGAVNALYQLDAKLQLEQQVATGPALDNKKCTPPIEASQCHEVCEEPLIWRDECCVDYCYQDCVVWNIHLHKFYMHSNFPFYMSSNYL

SEQ ID NO: 817181 - protein, 817 aa, Homo sapiens
MAFSPWQILSPVQWAKWTWSAVRGGAAGEDEAGGPEGDPEEEDSQAETKSLSFSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDIKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITTTEQVKFLCFLLSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 817182 - protein, 817 aa, Homo sapiens; identical to SEQ ID NO: 817181

SEQ ID NO: 817183 - protein, 791 aa, Homo sapiens
MRNQRQQVAQKGEGSDPGDRLWGPSPKSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDIKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITTTEQVKFLCFLLSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 817184 - protein, 817 aa, Homo sapiens; identical to SEQ ID NO: 817181

SEQ ID NO: 817185 - protein, 776 aa, Homo sapiens
MAFSPWQILSPVQWAKWTWSAVRGGAAGEDEAGGPEGDPEEEDSQAETKSLSFSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDIKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 817186 - protein, 395 aa, Homo sapiens
MAFSPWQILSPVQWAKWTWSAVRGGAAGEDEAGGPEGDPEEEDSQAETKSLSFRSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 817187 - protein, 344 aa, Homo sapiens
MEWSGCKVKKHETQSLALDACSRDEGAVISQISDISNRDGHATDEEKLASTSCGQKSAGAEVKGEPEEDLEYFECSNVPVSTINHAFSSSEAGIEKETCQKMEEDGSTVLGLLESSAEKAPVSVSCGGESPLDGICLSESDKTAVLTLIREEIITKEIEANEWKKKYEETRQEVLEMRKIVAEYEKTIAQMIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 817188 - protein, 154 aa, Homo sapiens
MIEDEQRTSMTSQKSFQQLTMEKEQALADLNSVERSLSDLFRRYENLKGVLEGFKKNEEALKKCAQDYLARVKQEEQRYQALKIHAEEKLDKANEEIAQVRTKAKAESAALHAGLRKEQMKVESLERALQQKNQEIEELTKICDELIAKLGKTD

SEQ ID NO: 817189 - protein, 117 aa, Homo sapiens
MELFRSPIFVFFLSCSQFFEACASQMSVVSILTGFDYVANHVLFVSLLHPNTINRANEEIAQVRTKAKAESAALHAGLRKEQMKVESLERALQQKNQEIEELTKICDELIAKLGKTD

SEQ ID NO: 817190 - protein, 817 aa, Homo sapiens; identical to SEQ ID NO: 817181

SEQ ID NO: 817191 - protein, 817 aa, Homo sapiens; identical to SEQ ID NO: 817181

SEQ ID NO: 817192 - protein, 817 aa, Homo sapiens; identical to SEQ ID NO: 817181

SEQ ID NO: 817193 - protein, 805 aa, Homo sapiens; identical to SEQ ID NO: 817178

SEQ ID NO: 817194 - protein, 805 aa, Homo sapiens; identical to SEQ ID NO: 817178

SEQ ID NO: 817195 - protein, 805 aa, Homo sapiens; identical to SEQ ID NO: 817178

SEQ ID NO: 817196 - protein, 586 aa, Homo sapiens
MAFSPWQILSPVQWAKWTWSAVRGGAAGEDEAGGPEGDPEEEDSQAETKSLSFSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDIKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKGIEKETCQKMEEDGSTVLGLLESSAEKAPVSVSCGGESPLDGICLSESDKTAVLTLIREEIH

SEQ ID NO: 817197 - protein, 476 aa, Homo sapiens
MAFSPWQILSPVQWAKWTWSAVRGGAAGEDEAGGPEGDPEEEDSQAETKSLSFSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDIKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITTTEQVKFLCFLL

SEQ ID NO: 817198 - protein, 464 aa, Homo sapiens
MAFSPWQILSPVQWAKWTWSAVRGGAAGEDEAGGPEGDPEEEDSQAETKSLSFSSDSEGNFETPEAETPIRSPFKESCDPSLGLAGPGAKSQESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDIKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLIT

SEQ ID NO: 817199 - protein, 1187 aa, Homo sapiens
HEARRGLKMAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 817200 - protein, 1215 aa, Homo sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEAEREYVFKNLPFKVYGGAVLYLFWGYLLQILESFPKDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 817201 - protein, 1211 aa, Homo sapiens
HEARRGLKMAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDRLQYRSETMAYKGLVWSQDVTGSPA

SEQ ID NO: 817202 - protein, 650 aa, Homo sapiens
MEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 817203 - protein, 668 aa, Homo sapiens
MTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 817204 - protein, 1032 aa, Homo sapiens
HEARRGLKMAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDELQSGDPLIIAAD

SEQ ID NO: 817205 - protein, 1029 aa, Homo sapiens
HEARRGLKMAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEVGFACKTGY

SEQ ID NO: 817206 - protein, 858 aa, Homo sapiens
HEARRGLKMAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMVMPPSLCSQKPQWARAWKAGERLGQGGGILSTTVMVKT

SEQ ID NO: 817207 - protein, 487 aa, Homo sapiens [sequence omitted]

SEQ ID NO: 817208 - protein, 434 aa, Homo sapiens
MKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 817209 - protein, 796 aa, Homo sapiens
HEARRGLKMAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKYVACSCFIPLSRSSS

SEQ ID NO: 817210 - protein, 757 aa, Homo sapiens
GTRLAADSRWRRVDVYGGCSACRRRCICCCYSRPGPRNSPARASHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKLQTNFPDKLLCASTWRGCGKLSQ

SEQ ID NO: 817211 - protein, 708 aa, Homo sapiens
HEARRGLKMAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEVSGMQLTHWRRVAASI

SEQ ID NO: 817212 - protein, 396 aa, Homo sapiens
MAACGRVRRMFRLSAALHLLLLFAAGAEKLPGQGVHSQGQGPGANFVSFVGQAGGGGPAGQQLPQLPQSSQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 817213 - protein, 131 aa, Homo sapiens
MDPRLPAWALVLLGPALVFALGPAPTPEMREKLCGHHFVRALVRVCGGPRWSTEARRPAAGGDRELLQWLERRHLLHGLVADSNLTLGPGLQPLPQTSHHHRHHRAAATNPARYCCLSGCTQQDLLTLCPY

SEQ ID NO: 817214 - protein, 138 aa, Homo sapiens
MDPRLPAWALVLLGPALVFALGPAPTPEMREKLCGHHFVRALVRVCGGPRWSTEARRPAAGGDPEFTLSPGELLQWLERRHLLHGLVADSNLTLGPGLQPLPQTSHHHRHHRAAATNPARYCCLSGCTQQDLLTLCPY

SEQ ID NO: 817215 - protein, 107 aa, Homo sapiens
PAPPTTMDPRLPAWALVLLGPALVFALGPAPTPEMREKLCGHHFVRALVRVCGGPRWSTEARRPAAGGDLPQTSHHHRHHRAAATNPARYCCLSGCTQQDLLTLCPY

SEQ ID NO: 817216 - protein, 133 aa, Homo sapiens
RCSLSSRSCFPCFVFSARGRPASVALWPAGIGRSTAKTPGPPGSLEMGPLTFRDVAIEFSLKEWQCLDTAQRNLYRNVMLENYRNLVFLGITVSKPDLITCLEQGKEAWSMKRHEIMVAKPTESYSVTQSGMQ

SEQ ID NO: 817217 - protein, 641 aa, Homo sapiens
RCSLSSRSCFPCFVFSARGRPASVALWPAGIGRSTAKTPGPPGSLEMGPLTFRDVAIEFSLKEWQCLDTAQRNLYRNVMLENYRNLVFLGITVSKPDLITCLEQGKEAWSMKRHEIMVAKPTVMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 817218 - protein, 608 aa, Homo sapiens
RCSLSSRSCFPCFVFSARGRPASVALWPAGIGRSTAKTPGPPGSLEMGPLTFRDVAIEFSLKEWQCLDTAQRNLYRNVMLENYRNLVFLVMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 817219 - protein, 543 aa, Homo sapiens
MSYELLRKVYILMLLRSVLYASVRIMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 817220 - protein, 518 aa, Homo sapiens
MCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 817221 - protein, 536 aa, Homo sapiens
MSLSAQPSSSFYKPVSEVMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 817222 - protein, 671 aa, Homo sapiens
RCSLSSRSCFPCFVFSARGRPASVALWPAGIGRSTAKTPGPPGSLEMGPLTFRDVAIEFSLKEWQCLDTAQRNLYRNVMLENYRNLVFLGITVSKPDLITCLEQGKEAWSMKRHEIMVAKPTGCLSKRMSYELLRKVYILMLLRSVLYASVRIMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 817223 - protein, 140 aa, Homo sapiens
LWGPCVVWRFSVLSSRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 817224 - protein, 201 aa, Homo sapiens
QHNLLLSRLGLKALITMRLLILTCLVAVALARPKLPLRYPERLQNPSESSEPIPLESREEYMNGMNRQRNILREKQTDEIKDTRNESTQNCVVAEPEKMESSISSSSEEMSLSKCAEQFCRLNEYNQLQLQAVHAQEQIRRMNENSHVQVPFQQLNQLAAYPYAVWYYPQIMQYVPFPPFSDISNPTAHENYEKNNVMLQW

SEQ ID NO: 817225 - protein, 112 aa, Homo sapiens
QHNLLLSRLGLKALITMRLLILTCLVAVALARPKLPLRYPERLQNPSESSEPIPLESREEYMNGMNRQRNILREKQTDEIKDTRNESTQNCVVAEPEKMESSISSSSEGTVL

SEQ ID NO: 817226 - protein, 173 aa, Homo sapiens
QHNLLLSRLGLKALITMRLLILTCLVAVALARPKLPLRYPERLQNPSESSEPIPLESREEYMNGMNRQRNILREKQTDEIKDTRNESTQNCVVAEPEKMESSISSSSEEQIRRMNENSHVQVPFQQLNQLAAYPYAVWYYPQIMQYVPFPPFSDISNPTAHENYEKNNVMLQW

SEQ ID NO: 817227 - protein, 184 aa, Homo sapiens
AAAASASQDELNQLERVFLRLGHAETDEQLQNIISKFLPPVLLKLSSTQEGVRKKVMELLVHLNKRIKSRPKIQLPVETLLVQYQDPAAVSFVTNFTIIYVKMGYPRLPVEKQCELAPTLLTAMEGKPQPQQDSLMHLLIPTLFHMKYPVESSKSASPFNLAEKPKTVQLLLDFMLDVLLMPYG

SEQ ID NO: 817228 - protein, 1650 aa, Homo sapiens
QNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 817229 - protein, 1642 aa, Homo sapiens
AAAASASQDELNQLERVFLRLGHAETDEQLQNIISKFLPPVLLKLSSTQEGVRKKVMELLVHLNKRIKSRPKIQLPVETLFETFHSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 817230 - protein, 1650 aa, Homo sapiens; identical to SEQ ID NO: 817228

SEQ ID NO: 817231 - protein, 1350 aa, Homo sapiens
DKSGETNPVQIYIGLLTCLAGVGGLPVMYCLLEAVSVYPEKLATKFVDKTEVDKDSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 817232 - protein, 974 aa, Homo sapiens
QNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVK

SEQ ID NO: 817233 - protein, 1615 aa, Homo sapiens
QNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEGKLLLVLTGGP

SEQ ID NO: 817234 - protein, 752 aa, Homo sapiens
MWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 817235 - protein, 632 aa, Homo sapiens
MNSLLDARSLSLTSMLFVCEVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 817236 - protein, 1476 aa, Homo sapiens
QNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKKTLENLE

SEQ ID NO: 817237 - protein, 1615 aa, Homo sapiens; identical to SEQ ID NO: 817233

SEQ ID NO: 817238 - protein, 1592 aa, Homo sapiens
QNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIGRYSPDVLKNHAKEVLPLAFLGMHEIADEEKSEKEECNLWTEVWQENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLGECSKLKLMRES

SEQ ID NO: 817239 - protein, 378 aa, Homo sapiens
GDLARLVAVLQGKHSTYDTDLFSPLLNAIQQGCRAPPYLGRVGVENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKNSLESSGVRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 817240 - protein, 177 aa, Homo sapiens
MLYLRTTKNEEENEKEKELQLEYLLGAFESLGKAWPRNAETQRCYRQELCKLMCERLKLSTWKVQLGVLQSMNAFFQGLMLLEEEHADPEALAEILLETCKSITYSLENKTYSSVRTEALSVIELLLKKLEESKQWECLTSECRVLLIESLATMEPDSRPELQEKAALLKKTLENLE

SEQ ID NO: 817241 - protein, 1270 aa, Homo sapiens
QNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSWLAFSMG

SEQ ID NO: 817242 - protein, 204 aa, Homo sapiens
GDLARLVAVLQGKHSTYDTDLFSPLLNAIQQGCRAPPYLGRVGVENVPGSFGGIRLYLQELITITQKALQSQSWKMKAQGAIAMASIAKQTSSLVPPYLGMILTALLQGLAGRTWAGKEELLKAIACVVTACSAELEKSVPNQPSTNEILQAVLKECSKENVKYKIVAISCAADILKATKEDRFQEFSNIVIPLIKKKTLENLE

SEQ ID NO: 817243 - protein, 1291 aa, Homo sapiens
QNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKGGCASVIVSLTTQCPQDLTPYSGKLMSALLSGLTDRNSVIQKSCAFAMGHLVRTSRDSSTEKLLQKLNGWYMEKEEPIYKTSCALTIHAIETSKTRPSFRSFIAPSFRSP

SEQ ID NO: 817244 - protein, 1194 aa, Homo sapiens
QNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTVTEVRALSINTLVKISKSAGAMLKPHAPKLIPALLESLSVLEPQVLNYLSLRATEQEKAAMDSARLSAAKSSPMMETINMCLQYLDVSVLGELVPRLCELIRSGVGLGTKVSVLSTRGNVHLH

SEQ ID NO: 817245 - protein, 1108 aa, Homo sapiens
QNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKLINEYKEDPKLLSMAYSAVGKLSSRMPHLFTKDIALVQQLFEALCKEEPETRLAIQEALSMMVGAYSTLEGAQRTLMEALVASYLIKPEVQVRQVAVKFASTVFPSDHIPSRYLLLLAAGDPREEVHGEAQRVLRCLPGRNRKESTSEQMPSFPEMVYYIQEKASHRMKTPVKYMTGTTVLPFNPAAFGEIVLYLRMCLAHSAGVVPTSQSLADMQDHAPAIGRYIRTLMSSGQMAPSSSNKSGETNPVQIYIGLLQQLLAGVGGLPVMYCLLEAVSVYPEKLATKFVDKTEWIKSLMNNSKEEMRELAALFYSVVVSTVSGNELKSMIEQLIKTTKDNHSPEIQHGSLLALGFTVGRYLAKKKMRMSEQQDLERNADTLPDQEELIQSATETIGSFLDSTSPLLAIAACTALGEIGRNGPLPIPSEGSGFTKLHLVESLLSRIPSSKETNKMKERAIQTLGYFPVGDGDFPHQKLLLQGLMDSVEAKQIELQFTIGEAITSAAIGTSSVAARDAWQMTEEEYTPPAGAKVNDVVPWVLDVILNKHIISPNPHVRQAACIWLLSLVRKLSTHKEVKSHLKEIQSAFVSVLSENDELSQDVASKGLGLVYELGNEQDQQELVSTLVETLMTGKRVKHEVSGETVVFQGGALGKTPDGQGLSTYKELCSLASDLSQPDLVYKFMNLANHHAMWNSRKGAAFGFNVIATRAGEQLAPFLPQLVPRLYRYQFDPNLGIRQAMTSIWNALVTDKSMVDKYLKEILQDLVKNLTSNMWRVRESSCLALNDLLRGRPLDDIIDKLPEIWETLFRVQDDIKESVRKAAELALKTLSKVCVKMCDPAKGAAGQRTIAALLPCLLDKGMMSTACTKTHSSSARVLKCIGAPSSQLFEPPGDRARKGCDG

SEQ ID NO: 817246 - protein, 180 aa, Homo sapiens
MYHIDCRDQLERVFLRLGHAETDEQLQNIISKFLPPVLLKLSSTQEGVRKKVMELLVHLNKRIKSRPKIQLPVETLLVQYQDPAAVSFVTNFTIIYVKMGYPRLPVEKQCELAPTLLTAMEGKPQPQQDSLMHLLIPTLFHMKYPVESSKSASPFNLAEKPKTVQLLLDFMLDVLLMPYG

SEQ ID NO: 817247 - protein, 223 aa, Homo sapiens
QNSSSAQGSSSNSGGGSGIPQPPPGMSFYAAKRVIGDNPWTPEQLEQCKLGIVKFIEAEQVPELEAVLHLVIASSDTRHSVATAADLELKSKQSLIDWNNPAIINKMYKVYLGDIPLKTKEGAVLKPELKRDPVSTRVKLKIVPHLLRSRQAAETFPANIQVVYDGLFGTNTNSKLRTLSLQFVHHICITCPEIKIKPLGPMLLNGLTKTKLAWYRARLYHVT

SEQ ID NO: 817248 - protein, 84 aa, Homo sapiens
MLLYGPCSAELEKSVPNQPSTNEILQAVLKECSKENVKYKIVAISCAADILKATKEDRFQEFSNIVIPLIKKVIPPVSSVLVYT

SEQ ID NO: 817249 - protein, 742 aa, Homo sapiens
MEEGFRDRAAFIRGAKDIAKEVKKHAAKKVVKGLDRVQDEYSRRSYSRFEEEDDDDDFPAPSDGYYRGEGTQDEEEGGASSDATEGHDEDDEIYEGEYQGIPRAESGGKGERMADGAPLAGVRGGLSDGEGPPGGRGEAQRRKEREELAQQYEAILRECGHGRFQWTLYFVLGLALMADGVEVFVVGFVLPSAEKDMCLSDSNKGMLGLIVYLGMMVGAFLWGGLADRLGRRQCLLISLSVNSVFAFFSSFVQGYGTFLFCRLLSGVGIGGSIPIVFSYFSEFLAQEKRGEHLSWLCMFWMIGGVYAAAMAWAIIPHYGWSFQMGSAYQFHSWRVFVLVCAFPSVFAIGALTTQPESPRFFLENGKHDEAWMVLKQVHDTNMRAKGHPERVFSVTHIKTIHQEDELIEIQSDTGTWYQRWGVRALSLGGQVWGNFLSCFGPEYRRITLMMMGVWFTMSFSYYGLTVWFPDMIRHLQAVDYASRTKVFPGERVEHVTFNFTLENQIHRGGQYFNDKFIGLRLKSVSFEDSLFEECYFEDVTSSNTFFRNCTFINTVFYNTDLFEYKFVNSRLINSTFLHNKEGCPLDVTGTGEGAYMVYFVSFLGTLAVLPGNIVSALLMDKIGRLRMLAGSSVMSCVSCFFLSFGNSESAMIALLCLFGGVSIASWNALDVLTVELYPSDKRTTAFGFLNALCKLAAVLGISIFTSFVGITKAAPILFASAALALGSSLALKLPETRGQVLQ

SEQ ID NO: 817250 - protein, 198 aa, Homo sapiens
NLRLGTRLGCKSAEADLFEYKFVNSRLINSTFLHNKEGCPLDVTGTGEGAYMVYFVSFLGTLAVLPGNIVSALLMDKIGRLRMLAGSSVMSCVSCFFLSFGNSESAMIALLCLFGGVSIASWNALDVLTVELYPSDKRTTAFGFLNALCKLAAVLGISIFTSFVGITKAAPILFASAALALGSSLALKLPETRGQVLQ

SEQ ID NO: 817251 - protein, 194 aa, Homo sapiens
MTACLSWPLPTDLFEYKFVNSRLINSTFLHNKEGCPLDVTGTGEGAYMVYFVSFLGTLAVLPGNIVSALLMDKIGRLRMLAGSSVMSCVSCFFLSFGNSESAMIALLCLFGGVSIASWNALDVLTVELYPSDKRTTAFGFLNALCKLAAVLGISIFTSFVGITKAAPILFASAALALGSSLALKLPETRGQVLQ

SEQ ID NO: 817252 - protein, 742 aa, Homo sapiens; identical to SEQ ID NO: 817249

SEQ ID NO: 817253 - protein, 742 aa, Homo sapiens; identical to SEQ ID NO: 817249

SEQ ID NO: 817254 - protein, 742 aa, Homo sapiens; identical to SEQ ID NO: 817249

SEQ ID NO: 817255 - protein, 742 aa, Homo sapiens; identical to SEQ ID NO: 817249

SEQ ID NO: 817256 - protein, 637 aa, Homo sapiens
MEEGFRDRAAFIRGAKDIAKEVKKHAAKKVVKGLDRVQDEYSRRSYSRFEEEDDDDDFPAPSDGYYRGEGTQDEEEGGASSDATEGHDEDDEIYEGEYQGIPRAESGGKGERMADGAPLAGVRGGLSDGEGPPGGRGEAQRRKEREELAQQYEAILRECGHGRFQWTLYFVLGLALMADGVEVFVVGFVLPSAEKDMCLSDSNKGMLGLIVYLGMMVGAFLWGGLADRLGRRQCLLISLSVNSVFAFFSSFVQGYGTFLFCRLLSGVGIGGSIPIVFSYFSEFLAQEKRGEHLSWLCMFWMIGGVYAAAMAWAIIPHYGWSFQMGSAYQFHSWRVFVLVCAFPSVFAIGALTTQPESPRFFLENGKHDEAWMVLKQVHDTNMRAKGHPERVFSVTHIKTIHQEDELIEIQSDTGTWYQRWGVRALSLGGQVWGNFLSCFGPEYRRITLMMMGVWFTMSFSYYGLTVWFPDMIRHLQAVDYASRTKVFPGERVEHVTFNFTLENQIHRGGQYFNDKFIGLRLKSVSFEDSLFEECYFEDVTSSNTFFRNCTFINTVFYNTDLFEYKFVNSRLINSTFLHNKEGCPLDVTGTGEGAYMVYFVSFLGTLAVLPGNIVSALLMDKIGRLRMLGKGERLSQI

SEQ ID NO: 817257 - protein, 485 aa, Homo sapiens
MEEGFRDRAAFIRGAKDIAKEVKKHAAKKVVKGLDRVQDEYSRRSYSRFEEEDDDDDFPAPSDGYYRGEGTQDEEEGGASSDATEGHDEDDEIYEGEYQGIPRAESGGKGERMADGAPLAGVRGGLSDGEGPPGGRGEAQRRKEREELAQQYEAILRECGHGRFQWTLYFVLGLALMADGVEVFVVGFVLPSAEKDMCLSDSNKGMLGLIVYLGMMVGAFLWGGLADRLGRRQCLLISLSVNSVFAFFSSFVQGYGTFLFCRLLSGVGIGGSIPIVFSYFSEFLAQEKRGEHLSWLCMFWMIGGVYAAAMAWAIIPHYGWSFQMGSAYQFHSWRVFVLVCAFPSVFAIGALTTQPESPRFFLENGKHDEAWMVLKQVHDTNMRAKGHPERVFSVTHIKTIHQEDELIEIQSDTGTWYQRWGVRALSLGGQVWGNFLSCFGPEYRRITLMMMGVWFTMSFSYYGLTVWFPDTSVLSVTTVVKHRPA

SEQ ID NO: 817258 - protein, 195 aa, Homo sapiens
RPPRETVRLELVLKDPTDESCVEFSYPELLLCGEQRKKLIHTEDPFNDEHQERQEVEMLAKKFEMKYGGKPRKHRKDRLQDLIDIGFGYDETDPFIDNSEAYDELVPASLTTKYGGFYINTGTLQFRQASDTEEDDITDNQKHKPPKVPKIKEDDIEMKKRKRKEEGEKEKKPRKKVPKQLGVVALNSHKSENNK

SEQ ID NO: 817259 - protein, 685 aa, Homo sapiens
RPPRETVRLELVLKDPTDESCVEFSYPELLLCGEQRKKLIHTEDPFNDEHQERQEVEMLAKKFEMKYGGKPRKHRKDRLQDLIDIGFGYDETDPFIDNSEAYDELVPASLTTKYGGFYINTGTLQFRQASDTEEDDITDNQKHKPPKVPKIKEDDIEMKKRKRKEEGEKEKKPRKKVPKQLGVVALNSHKSEKKKKRYKDSLSLAAMIRKFQKEKDALKKESNPKVPVTLSTPSLNKPPCAAAALGNDVPDLNLSSGDPDLPIFVSTNEHELFQEAENALEMLDDFDFDRLLDAASDGSPLSESGGENGTTTQPTYTSQVMPKVVPTLPEGLPVLLEKRIEDLRVAAKLFDEEGRKKFFTQDMNNILLDIELQLQELGPVIRSGVYSHLEAFVPCNKETLVKRLKKLHLNVQDDRLREPLQKLKLAVSNVMPEQLFKYQEDCQARSQAKCAKLQTDEEREKNGSEEDDDEKPGKRVIGPRKKFHWDDTIRTLLCNLVEIKLGCYELEPNKSQSAEDYLKSFMETEVKPLWPKGWMQARMLFKESRSVHNHLTSAPAKKKVIPAPKPKVKEVMVKTLPLHSFPTMLKECSPKKDQKTPTSLVASVSGPPTSSSTAAIAAASSSSAPAQETICLDDSLDEDLSFHSPSLDLVSEALAVINNGNKGPPVGSRISMPTTKPRPGLREEK

SEQ ID NO: 817260 - protein, 592 aa, Homo sapiens
MSYRENHIYDELVPASLTTKYGGFYINTGTLQFRQASDTEEDDITDNQKHKPPKVPKIKEDDIEMKKRKRKEEGEKEKKPRKKVPKQLGVVALNSHKSEKKKKRYKDSLSLAAMIRKFQKEKDALKKESNPKVPVTLSTPSLNKPPCAAAALGNDVPDLNLSSGDPDLPIFVSTNEHELFQEAENALEMLDDFDFDRLLDAASDGSPLSESGGENGTTTQPTYTSQVMPKVVPTLPEGLPVLLEKRIEDLRVAAKLFDEEGRKKFFTQDMNNILLDIELQLQELGPVIRSGVYSHLEAFVPCNKETLVKRLKKLHLNVQDDRLREPLQKLKLAVSNVMPEQLFKYQEDCQARSQAKCAKLQTDEEREKNGSEEDDDEKPGKRVIGPRKKFHWDDTIRTLLCNLVEIKLGCYELEPNKSQSAEDYLKSFMETEVKPLWPKGWMQARMLFKESRSVHNHLTSAPAKKKVIPAPKPKVKEVMVKTLPLHSFPTMLKECSPKKDQKTPTSLVASVSGPPTSSSTAAIAAASSSSAPAQETICLDDSLDEDLSFHSPSLDLVSEALAVINNGNKGPPVGSRISMPTTKPRPGLREEK

SEQ ID NO: 817261 - protein, 360 aa, Homo sapiens
IQVRYDTRFFCLLVEVCNFNAAKLFDEEGRKKFFTQDMNNILLDIELQLQELGPVIRSGVYSHLEAFVPCNKETLVKRLKKLHLNVQDDRLREPLQKLKLAVSNVMPEQLFKYQEDCQARSQAKCAKLQTDEEREKNGSEEDDDEKPGKRVIGPRKKFHWDDTIRTLLCNLVEIKLGCYELEPNKSQSAEDYLKSFMETEVKPLWPKGWMQARMLFKESRSVHNHLTSAPAKKKVIPAPKPKVKEVMVKTLPLHSFPTMLKECSPKKDQKTPTSLVASVSGPPTSSSTAAIAAASSSSAPAQETICLDDSLDEDLSFHSPSLDLVSEALAVINNGNKGPPVGSRISMPTTKPRPGLREEK

SEQ ID NO: 817262 - protein, 128 aa, Homo sapiens
MAEQVKCASAGVSSGAGSGPVVNAELEVKKLQELVRKLEKQNEQLRSRAASAAAAPHLLLLPPPPPAAPPPAGLQPLGPRSPPAATATAAASGGLGLGLALGAGGGGGSGSGSGGGSSPAFPGTFCLP

SEQ ID NO: 817263 - protein, 305 aa, Homo sapiens
MGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 817264 - protein, 443 aa, Homo sapiens
MNSANKEDFSWSGMNRLYIGSSKTFTSSEKSLTPLQWCRHVLDNPTPEMEAARRSLCFRLEQVYIGSSKTFTSSEKSLTPLQWCRHVLDNPTPEMEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 817265 - protein, 449 aa, Homo sapiens
PPEAPFVYFKPAAGFFGAGGGGPEPGGAGTPPGAAAAPPSPPPTLLDEVELLDLESVAAWRDEDDYTWLYIGSSKTFTSSEKSLTPLQWCRHVLDNPTPEMEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 817266 - protein, 305 aa, Homo sapiens; identical to SEQ ID NO: 817263

SEQ ID NO: 817267 - protein, 499 aa, Homo sapiens
PPEAPFVYFKPAAGFFGAGGGGPEPGGAGTPPGAAAAPPSPPPTLLDEVELLDLESVAAWRDEDDYTWLYIGSSKTFTSSEKSLTPLQWCRHVLDNPTPEMEAARRSLCFRLEQASRWRSLFSSTASLAFPYSPVARLSPYSNGINTPSFSKTSNKAILTPEKTGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 817268 - protein, 305 aa, Homo sapiens; identical to SEQ ID NO: 817263

SEQ ID NO: 817269 - protein, 349 aa, Homo sapiens
MEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 817270 - protein, 305 aa, Homo sapiens; identical to SEQ ID NO: 817263

SEQ ID NO: 817271 - protein, 138 aa, Homo sapiens
AVRPGITGSGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 817272 - protein, 256 aa, Homo sapiens
MNSANKEDFSWSGMNRLYIGSSKTFTSSEKSLTPLQWCRHVLDNPTPEMEAARRSLCFRLEQVYIGSSKTFTSSEKSLTPLQWCRHVLDNPTPEMEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYKLQLLG

SEQ ID NO: 817273 - protein, 286 aa, Homo sapiens
MNSANKEDFSWSGMNRLYIGSSKTFTSSEKSLTPLQWCRHVLDNPTPEMEAARRSLCFRLEQVYIGSSKTFTSSEKSLTPLQWCRHVLDNPTPEMEAARRSLCFRLEQGYTSRGSPLSPQSSIDSELSTSELEDDSISMGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRRFLQPPKPL

SEQ ID NO: 817274 - protein, 1247 aa, Homo sapiens
MPILCWLLPNIKIPLFLGNVQIFGKAQHPNQAAVWLLNGLQLFLHSKWNELAVCVCGGGGRGWCMCVCVCASAAASKLEILQDTPVMDWWQLGGTADVHCVGGNPVVVGYLNAPRQASDVCSYQKHFRFKKSEMMVVLVSGEIEKPQMMRISFCPLSFFCNPFKTINKPILLSPYFFLEAQGFLSASQNIFVVNWEKVILGLGGVGIKNGGRPDFKIQARTPNDSTHESHFRSHLVHHLYFEVEEVEAGKEQDQRKNPDFLMLGPHTSSLSISLIAVYVLLENTKWIIFFRITFEPTIFNNNSTSSILLLIEYKEMFLYGILEGAGDEAWHSPKFKSPIINCILNCFKLAHFQGNFFCVSVTELLHPCHSLPILPNPILALKFHCVNFCTVYTHQVSKHLPPLPILLPLFYTHTHTHTHNPSLACSYLLIFLPYRNRNRDKEGENVYIGAGLNNNFISSINWGKLREKLLFLFTVLERIAISMTAFVLMDFSISLDVNYSVFLAEGTLRSHHLLLYSKFLILQARKPRHRGKVISPRSHSWLGQDWVYNPHLLALIPGPFPTEVVLPSIRLLRVISQGHVASWSHMLLALISVGNPPSNLIQPLFPAFTWFPSTWVADVLEESEALRANRSNGVPGLVHLIQEITAAIVRSPLNSPPLNACLAQMEWRKIDFLHQFTLCHLINGWSFQAEGNVSCFQSRKKKEWNNSFVHPNFLRWLFNILKKLVWYHSLAGFLLEYGSKMSRENNLVSLWLPSSTMSPKPSCSDEDNFQVYSKGLCDKNVPWLMLNIGSCVCTKIASCVLYTLFPSSCVHCSCGLPQQKPGQKGPNTWFSLLQGSSWELRGYLLVQFKRPPSGLTPLLRYFSLLPPSPPQSQVTKEPESGCVAIWRRQGTLRFFFESFSPSLRPVIGAYLEQNFVCVPNPFNYSGYNAPNHPAHLILNGFYFLKIHIPRTREQDAYIPKMSSRTLMGMIPKITPPQKRLCQETSPDRNTGTVVGTTSFMVVQFAMEIKGIDFLKKMIGTCLWPHEGHLDPFPGLTHILPSLKGFGFKSQTGLPSEPEVFWSSSGVRHENVAPSIPSGKGAFPPFLLKPGPPEIVFVSKSLVWSLYTQTLSVASCLVSLLRIYADLPLWLSQRDIGYHLTRLTFFFFFFDLSLPLSPRLECSGTILARCNLHPSPPRSKRFSCLSLPSSWDYRRAPPNLAIFLLLLFLVEMGFHHVGQTGLELLASNYLPTSASQSAGITGMSTMPS

SEQ ID NO: 817275 - protein, 1161 aa, Homo sapiens
MDWWQLGGTADVHCVGGNPVVVGYSNAPRQASDVCSYQKHFRFKKSEMMVVLVSGEIEKPQMMRISFCPLSFFCNPFKTINKPILLSPYFFLEAQGFLSASQNIFVVNWEKVILGLGGVGIKNGGRPDFKIQARTPNDSTHESHFRSHLVHHLYFEVEEVEAGKEQDQRKNPDFLMLGPHTSSLSISLIAVYVLLENTKWIIFFRITFEPTIFNNNSTSSILLLIEYKEMFLYGILEGAGDEAWHSPKFKSPIINCILNCFKLAHFQGNFFCVSVTELLHPCHSLPILPNPILALKFHCVNFCTVYTHQVSKHLPPLPILLPLFYTHTHTHTHNPSLACSYLLIFLPYRNRNRDKEGENVYIGAGLNNNFISSINWGKLREKLLFLFTVLERIAISMTAFVLMDFSISLDWNYSVFLAEGTLRSHHLLLYSKFLILQARKPRHRGKVISPRSHSWLGQDWVYNPHLLALIPGPFPTEVVLPSIRLLRVISQGHVASWSHMLLALISVGNPPSNLIQPLFPAFTWFPSTWVADVLEESEALRANRSNGVPGLVHLIQEITAAIVRSPLNSPPLNACLAQMEWRKIDFLHQFTLCHLINGWSFQAEGNVSCFQSRKKKEWNNSFVHPNFLRWLFNILKKLVWYHSLAGFLLEYGSKMSRENNLVSLWLPSSTMSPKPSCSDEDNFQDISKGLCDKNVPWLMLNIGSCVCTKIASCVLYTLFPSSCVHCSCGLPQQKPGQKGPNTWFSLLQGSSWELRGYLLVQFKRPPSGLTPLLRYFSLLPPSPPQSQVTKEPESGCVAISRRQGTLRFFFESFSPSLRPVIGAYLEQNFVCVPNPFNYSGYNAPNHPAHLILNGFYFLKIHIPRTREQDAYIPKMSSRTLMGMIPKITPPQKRLCQETSPDRNTGTVVGTTSFMVVQFAMEIKGIDFLKKMIGTCLWPHKGHLDPFPGLTHILPSLKGFGFKSQTGLPSEPEVFWSSSGVRHENVAPSIPSGKGAFPPFLLKPGPPEIVFVSKSLVWSLYTQTLSVASCLVSLLRIYADLPLWLSQRDIGYHLTRLTFFFFFFDLSLPLSPRLECSGTILARCNLHPSPPRSKRFSCLSLPSSWDYRRAPPNLAIFLLLLFLVEMGFHHVGQTGLELLASNYLPTSASQSAGITGMSTMPS

SEQ ID NO: 817276 - protein, 1161 aa, Homo sapiens; identical to SEQ ID NO: 817275

SEQ ID NO: 817277 - protein, 1162 aa, Homo sapiens
MDWWQLGGTADVHCVGGNPVVVGYLNAPRQASDVCSYQKHFRFKKSEMMVVLVSGEIEKPQMMRISFCPLSFFCNPFKTINKPILLSPYFFLEAQGFLSASQNIFVVNWEKVILGLGGVGIKNGGRPDFKIQARTPNDSTHESHFRSHLVHHLYFEVEEVEAGKEQDQRKNPDFLMLGPHTSSLSISLIAVYVLLENTKWIIFFRITFEPTIFNNNSTSSILLLIEYKEMFLLAILEGAGDEAWHSPKFKSPIINCILNCFKLAHFQGNFFCVSVTELLHPCHSLPILPNPILALKFHCVNFCTVYTHQVSKHLPPLPILLPLFYTHTHTHTHNPSLACSYLLIFLPYRNRNRDKEGENVYIGAGLNNKLHKYVLTRGEIERKAPFLFTVLERIAISMTAFVLMDFSISLDVNYSVFLAEGTLRSHHLLLYSKFLILQARKPRHRGKVISPRSHSWLGQDWVYNPHLLALIPGPFPTEVVLPSIRLLRVISQGHVASWSHMLLALISVGNPPSNLIQPLFPAFTWFPSTWVADVLEESEALRANRSNGVPGLVHLIQEITAAIVRSPLNSPPLNACLAQMEWRKIDFLHQFTLCHLINGWSFQAEGNVSCFQSRKKKEWNNSFVHPNFLRWLFNILKKLVWYHSLAGFLLEYGSKMSRENNLVSLWLPSSTMSPKPSCSDEDNFQVYSKGLCDKNVPWLMLNIGSCVCTKIASCVLYTLFPSSCVHCSCGLPQQKPGQKGPNTWFSLLQGSSWELRGYLLVQFKRPPSGLTPLLRYFSLLPPSPPQSQVTKEPESGCVAISRRQGTLRFFFESFSPSLRPVIGAYLEQNFVCVPNPFNYSGYNAPNHPAHLILNGFYFLKIHIPRTREQDAYIPKMSSRTLMGMIPKITPPQKRLCQETSPDRNTGTVVCTTSFMVVQFAMEIKGIDFLKKMIGTCLWPHEGHLDPFPGLTHILPSLKGFGFKSQTGLPSEPEVFWSSSGVRHENVAPSIPSGKGAFPPFLLKPGPPEIVFVSKSLVWSLYTQTLSVASCLVSLLRIYADLPLWLSYRDIGYHLTRLTFFFFFFDLSLPLSPRLECSGTILARCNLHPSPPRSKRFSCLSLPSSWDYRRAPPNLAIFLLLLFLVEMGFHHVGQTGLELLASNYLPTSASQSAGITGMSTMPS

SEQ ID NO: 817278 - protein, 114 aa, Homo sapiens
MSALSLLILGLLTAVPPASCQQGLGNLQPWMQGLIAVAVFLVLVAIAFAVNHFWCQEEPEPAHMILTVGNKADGVLVGTDGRYSSMAASFRSSEHENAYENVPEEEGKVRSTPM

SEQ ID NO: 817279 - protein, 114 aa, Homo sapiens; identical to SEQ ID NO: 817278

SEQ ID NO: 817280 - protein, 100 aa, Homo sapiens
GSWMDVSATPKPLLLCVESAIVGCLPPAPCRPYPPLKYSQPRLEPEPAHMILTVGNKADGVLVGTDGRYSSMAASFRSSEHENAYENVPEEEGKVRSTPM

SEQ ID NO: 817281 - protein, 131 aa, Homo sapiens
MAGIKALISLSFGGAIGLMFLMLGCALPIYNKYWPLFVLFFYILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 817282 - protein, 169 aa, Homo sapiens
MAGIKALISLSFGGAIGLMFLMLGCALPIYNKYWPLFVLFFYILSPIPYCIARRLVDDTDAMSNACKELAIFLTTGIVVSAFGLPIVFARAHLMGRLPFFSKMGTAESEGRETLTQQLPLPAAAMRRLLPASRVSTQPVLRLADSAESLLGRPALWALGFLLCPPSQAQ

SEQ ID NO: 817283 - protein, 131 aa, Homo sapiens; identical to SEQ ID NO: 817281

SEQ ID NO: 817284 - protein, 131 aa, Homo sapiens; identical to SEQ ID NO: 817281

SEQ ID NO: 817285 - protein, 95 aa, Homo sapiens
TKLAGPILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 817286 - protein, 92 aa, Homo sapiens
QRQTLSGVKGRSGFHTEENPSSGQTGRVCRRDEVWDITPALTGCLCGSEERKLAFPLTCSCRIRHEGAFPLEAESGLWYYNVQISRGRCRYT

SEQ ID NO: 817287 - protein, 207 aa, Homo sapiens
RRGSDPRPGPALGPEVGAAPSGNGRLRPRLRPAAPTFCRFRQPLSHPSPPGQNMKWLAVSEESRRDLDGHTRFAGVCIRERALISLSFGGAIGLMFLMLGCALPIYNKYWPLFVLFFYILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 817288 - protein, 142 aa, Homo sapiens
RRPRVGSDDSAGRQSTALISLSFGGAIGLMFLMLGCALPIYNKYWPLFVLFFYILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 817289 - protein, 156 aa, Homo sapiens
RRGSDPRPGPALGPEVGAAPSGNGRLRPRLRPAAPTFCRFRQPLSHPSPPGQNMKWLAVSEESRRDLDGHTRFAGVCIRERGRQSVGLRRLRLLEMPAMENQSFPTERHKCGLRALHGSARNLDPTSTPAARARGFTGSRNGCIFICGVWTLELIL

SEQ ID NO: 817290 - protein, 113 aa, Homo sapiens
MFLMLGCALPIYNKYWPLFVLFFYILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 817291 - protein, 137 aa, Homo sapiens
YGVCRNGMISKALIDSPCGAIGLMVDALACVPVQLYNKYWPLFVLFFYILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 817292 - protein, 131 aa, Homo sapiens; identical to SEQ ID NO: 817281

SEQ ID NO: 817293 - protein, 473 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLGTDRDWGGKAAASLRHLCGPATLLVF

SEQ ID NO: 817294 - protein, 507 aa, Homo sapiens
MGAGPGRGGGPWAPRVGAGSEAGWLRRSADVAAQMASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLGTDRDWGGKAAASLRHLCGPATLLVF

SEQ ID NO: 817295 - protein, 454 aa, Homo sapiens
MASRLTLLTLLLLLLAGDRASSNPNATRTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLGTDRDWGGKAAASLRHLCGPATLLVF

SEQ ID NO: 817296 - protein, 425 aa, Homo sapiens
MLPAPAPRIQRVCKTEAKGRSQPTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLGTDRDWGGKAAASLRHLCGPATLLVF

SEQ ID NO: 817297 - protein, 176 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMATSPVSTRP

SEQ ID NO: 817298 - protein, 608 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPVDWRLLQSKSQEVLSQTSTKARKQSLFRAKIKGRKEGKSRQMEFNISKRLSCRAIVTYKLRQRRLGATSLVLGSGFTFFGPYLPHLEEEWAGPRSTMPYSLSEQKNHRKHAHSQIVLMERTTCSGLMPPFLNIPPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLGTDRDWGGKAAASLRHLCGPATLLVF

SEQ ID NO: 817299 - protein, 164 aa, Homo sapiens
MEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLGTDRDWGGKAAASLRHLCGPATLLVF

SEQ ID NO: 817300 - protein, 262 aa, Homo sapiens
MTIYTGTRTLRTYHRPGDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLGTDRDWGGKAAASLRHLCGPATLLVF

SEQ ID NO: 817301 - protein, 516 aa, Homo sapiens
MGAGPGRGGGPWAPRVGAGSEAGWLRRSADVAAQMASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSEQPSHLFPLAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLGTDRDWGGKAAASLRHLCGPATLLVF

SEQ ID NO: 817302 - protein, 343 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVSGAAAALPQSEFGDPGTPEPETSS

SEQ ID NO: 817303 - protein, 164 aa, Homo sapiens; identical to SEQ ID NO: 817299

SEQ ID NO: 817304 - protein, 156 aa, Homo sapiens
MSLKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLGTDRDWGGKAAASLRHLCGPATLLVF

SEQ ID NO: 817305 - protein, 152 aa, Homo sapiens
YFRLETGFSSFFMHLYYIEWQNVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLGTDRDWGGKAAASLRHLCGPATLLVF

SEQ ID NO: 817306 - protein, 152 aa, Homo sapiens
KLRGELLTQAELQGELRGELLTVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLGTDRDWGGKAAASLRHLCGPATLLVF

SEQ ID NO: 817307 - protein, 473 aa, Homo sapiens; identical to SEQ ID NO: 817293

SEQ ID NO: 817308 - protein, 476 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLKFCEPCCCLPGLGPCHLLPQVSAIHQKGSLRVWARDLLLLALLSMALPCSPNHFLQLSLVQVHQTL

SEQ ID NO: 817309 - protein, 434 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLILRFFLSVQHPGSVQHPG

SEQ ID NO: 817310 - protein, 382 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRALGPAAQVPCLHGASI

SEQ ID NO: 817311 - protein, 386 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKFVGQKLDTTGNWKRVSYIGKASTWHVVLQIKLQADHAFVYLSK

SEQ ID NO: 817312 - protein, 373 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKCAWVQKCAWVQKCAWVQKCAWVQKCAWVQKCAWVQKCAWVQKRL

SEQ ID NO: 817313 - protein, 259 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKSSWGEYMTPGPETCRIRLGRALPLQPQLSSFASPAAACLDLAPATSCLRCPLSTKRAP

SEQ ID NO: 817314 - protein, 230 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPVD

SEQ ID NO: 817315 - protein, 348 aa, Homo sapiens
MAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKSVAWEGGACPAFLPSLRPPPLTSPSHGSLSHSKAPSGSQMSHNAVTSHQRPGWPGQPHSPFPHPTPHFQPDASLLQPVTPLGTSRWRKISAALPY

SEQ ID NO: 817316 - protein, 339 aa, Homo sapiens
MAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKDIAVEEDLSSTPLLKDLLELTRREFQREDIALNYRDAEGDLVRLLSDEDVALMVRQARGLPSQKRLFPWKLHITQKDNYRVYNTMP

SEQ ID NO: 817317 - protein, 382 aa, Homo sapiens
GRVSPSQSQAEFTSHFLQPPCVSSQPGTGWARLSTCSLGPSPTMAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKDIAVEEDLSSTPLLKDLLELTRREFQREDIALNYRDAEGDLVRLLSDEDVALMVRQARGLPSQKRLFPWKLHITQKDNYRVYNTMP

SEQ ID NO: 817318 - protein, 212 aa, Homo sapiens
WSQGDLGSIPSSSTKKWGGLREVAYSPQASVSTSVKWETKALFDFTGNSKLELNFKAGDVIFLLSRINKDWLEGTVRGATGIFPLSFVKILKDFPEEDDPTNWLRCYYYEDTISTIKSVAWEGGACPAFLPSLRPPPLTSPSHGSLSHSKAPSGSQMSHNAVTSHQRPGWPGQPHSPFPHPTPHFQPDASLLQPVTPLGTSRWRKISAALPY

SEQ ID NO: 817319 - protein, 72 aa, Homo sapiens
MASLLFLLQGTVRGATGIFPLSFVKILKDFPEEDDPTNWLRCYYYEDTISTIKSVAWEGGACPAFLPSLRPP

SEQ ID NO: 817320 - protein, 624 aa, Homo sapiens
EGVLARPGAAGGGPGLPSVPPPGLGAWLADVALAALRAGGQGRRDRGGGGPESLSGGSGVGDSGGGCAPGPSAPPARRRVPLAMGHSPPVLPLCASVSLLGGLTFGYELAVISGALLPLQLDFGLSCLEQEFLVGSLLLGALLASLVGGFLIDCYGRKQAILGSNLVLLAGSLTLGLAGSLAWLVLGRAVVGFAISLSSMACCIYVSELVGPRQRGVLVSLYEAGITVGILLSYALNYALAGTPWGWRHMFGWATAPAVLQSLSLLFLPAGTDETATHKDLIPLQGGEAPKLGPGRPRYSFLDLFRARDNMRGRTTVGLGLVLFQQLTGQPNVLCYASTIFSSVGFHGGSSAVLASVGLGAVKVAATLTAMGLVDRAGRRALLLAGCALMALSVSGIGLVSFAVPMDSGPSCLAVPNATGQTGLPGDSGLLQDSSLPPIPRTNEDQREPILSTAKKTKPHPRSGDPSAPPRLALSSALPGPPLPARGHALLRWTALLCLMVFVSAFSFGFGPVTWLVLSEIYPVEIRGRAFAFCNSFNWAANLFISLSFLDLIGTIGLSWTFLLYGLTAVLGLGFIYLFVPETKGQSLAEIDQQFQKRRFTLSFGHRQNSTGIPYSRIEISAAS

SEQ ID NO: 817321 - protein, 624 aa, Homo sapiens; identical to SEQ ID NO: 817320

SEQ ID NO: 817322 - protein, 250 aa, Homo sapiens
EGVLARPGAAGGGPGLPSVPPPGLGAWLADVALAALRAGGQGRRDRGGGGPESLSGGSGVGDSGGGCAPGPSAPPARRRVPLAMGKSRSGAACWKPDPFPGCRHRPHAPLRVRAPWLPQGRPGRIPPLGWPARDCRPAAGAGTGLGRASFHLPFCPGKVAPHLLQRPLGPRHSPGRPDPTAPGKCSCSWSADEEMEAPKEAKQFIDSLSAVVPQALLWAWGRCRERNCEQNRRTPSSGRDSAERGQRRRF

SEQ ID NO: 817323 - protein, 554 aa, Homo sapiens
LTIGLTHYRARAAARHSPPVLPLCASVSLLGGLTFGYELAVISGALLPLQLDFGLSCLEQEFLVGSLLLGALLASLVGGFLIDCYGRKQAILGSNLVLLAGSLTLGLAGSLAWLVLGRAVVGFAISLSSMACCIYVSELVGPRQRGVLVSLYEAGITVGILLSYALNYALAGTPWGWRHMFGWATAPAVLQSLSLLFLPAGTDETATHKDLIPLQGGEAPKLGPGRPRYSFLDLFRARDNMRGRTTVGLGLVLFQQLTGQPNVLCYASTIFSSVGFHGGSSAVLASVGLGAVKVAATLTAMGLVDRAGRRALLLAGCALMALSVSGIGLVSFAVPMDSGPSCLAVPNATGQTGLPGDSGLLQDSSLPPIPRTNEDQREPILSTAKKTKPHPRSGDPSAPPRLALSSALPGPPLPARGHALLRWTALLCLMVFVSAFSFGFGPVTWLVLSEIYPVEIRGRAFAFCNSFNWAANLFISLSFLDLIGTIGLSWTFLLYGLTAVLGLGFIYLFVPETKGQSLAEIDQQFQKRRFTLSFGHRQNSTGIPYSRIEISAAS

SEQ ID NO: 817324 - protein, 624 aa, Homo sapiens; identical to SEQ ID NO: 817320

SEQ ID NO: 817325 - protein, 356 aa, Homo sapiens
MPEGEDFGPGKSWEVINSKPDERPRLSHCIAESWMNFSIFLQEMSLFKQQSPGKFCLLVCSVCTFFTILGSYIPGVILSYLLLLCAFLCPLFKCNDIGQKIYSKIKSVLLKLDFGIGEYINQKKRERSEADKEKSHKDDSELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 817326 - protein, 107 aa, Homo sapiens [sequence omitted]

SEQ ID NO: 817327 - protein, 497 aa, Homo sapiens
MASPAPPEHAEEGCPAPAAEEQAPPSPPPPQASPAERQQQEEEAQEAGAAEGAGLQVEEAAGRAAAAVTWLLGEPVLWLGCRADELLSWKRPLRSLLGFVAANLLFWFLALTPWRVYHLISVMILGRVIMQIIKDMVLSRTRGAQLWRSLSESWEVINSKPDERPRLSHCIAESWMNFSIFLQEMSLFKQQSPGKFCLLVCSVCTFFTILGSYIPGVILSYLLLLCAFLCPLFKCNDIGQKIYSKIKSVLLKLDFGIGEYINQKKRERSEADKEKSHKDDSELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 817328 - protein, 497 aa, Homo sapiens; identical to SEQ ID NO: 817327

SEQ ID NO: 817329 - protein, 497 aa, Homo sapiens; identical to SEQ ID NO: 817327

SEQ ID NO: 817330 - protein, 497 aa, Homo sapiens; identical to SEQ ID NO: 817327

SEQ ID NO: 817331 - protein, 497 aa, Homo sapiens; identical to SEQ ID NO: 817327

SEQ ID NO: 817332 - protein, 497 aa, Homo sapiens; identical to SEQ ID NO: 817327

SEQ ID NO: 817333 - protein, 497 aa, Homo sapiens; identical to SEQ ID NO: 817327

SEQ ID NO: 817334 - protein, 107 aa, Homo sapiens [sequence omitted]

SEQ ID NO: 817335 - protein, 140 aa, Homo sapiens
MPGTAAEDPVNCPTCCGKLPCVGSWYWGGGRGQMALKLLLLLFREKVAVASEGTAVAVNASCRRSKERRLGEIQHMSQACLLSLLPVPRDVLETEDEEPPPRRWCNTCQLYYMGDLIQHRRTQDHKVGGPARCRGTRTAV

SEQ ID NO: 817336 - protein, 133 aa, Homo sapiens
SRCGGRGTEATMFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQDLDQFAMPPGSVSTYFLREIAIENVIE

SEQ ID NO: 817337 - protein, 908 aa, Homo sapiens
HDSSGQAKGRATLTGAPHPGAVAKQGAGCSEKDKKWFLLPSSLPHPAARASPLAALRTDGGGSRRATMFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 817338 - protein, 898 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 817339 - protein, 898 aa, Homo sapiens; identical to SEQ ID NO: 817338

SEQ ID NO: 817340 - protein, 898 aa, Homo sapiens; identical to SEQ ID NO: 817338

SEQ ID NO: 817341 - protein, 874 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 817342 - protein, 905 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPTPTTSALNPPQNLIEGPPCPWPAWVQIC

SEQ ID NO: 817343 - protein, 865 aa, Homo sapiens
MFSQQQQQQLQQQQQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 817344 - protein, 841 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 817345 - protein, 871 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 817346 - protein, 835 aa, Homo sapiens
MFSQQQQQQLQQQQQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 817347 - protein, 971 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGKGALAPSWSGDGTALPRPFIPPLTGCCLGLRAEAWNPGPGPSMLGASRFWLRTEKAALGPGDSGKYSTSVISGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 817348 - protein, 696 aa, Homo sapiens
MPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 817349 - protein, 785 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 817350 - protein, 680 aa, Homo sapiens
TYGWVRGLGYQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 817351 - protein, 890 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 817352 - protein, 858 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRWATGSVPRSRR

SEQ ID NO: 817353 - protein, 842 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHKRIRQELIKRPESSLNRDMEPPVR

SEQ ID NO: 817354 - protein, 801 aa, Homo sapiens [sequence omitted]

SEQ ID NO: 817355 - protein, 308 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQLPNNPCDPSAPFATATSKPLASLWST

SEQ ID NO: 817356 - protein, 740 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVWTSWCP

SEQ ID NO: 817357 - protein, 712 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHPGQNTQQGDGSTLPAPTTSALNPPQNLIEGPPCPWPAWVQIC

SEQ ID NO: 817358 - protein, 534 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLGEVQRYIQRGVEGLGDLQPQYCIWCGLPGARDGLYLPHLPQVLSQQLRGTALPLQVPGPL

SEQ ID NO: 817359 - protein, 465 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPVHTQAQPSVQPQEHPPAQVSVQPPEQTHEQPHTQPQVSLLAPEQTPVVVHVCGLEMPPDAVEAGGGMEKTLARALWHPSQHGTDIGIL

SEQ ID NO: 817360 - protein, 425 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPALPLSRPSSSSATSARPAAPASRSSRTTCRSLSTSSG

SEQ ID NO: 817361 - protein, 441 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPPQVQPQAHSQPPRQVQLQLQKQVQTQTYPQVHTQAQPSVQPQEHPPAQVSVQPPEQKVDGDPAR

SEQ ID NO: 817362 - protein, 425 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 817363 - protein, 414 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPHLPQVLSQQLRGTALPLQVPGPL

SEQ ID NO: 817364 - protein, 359 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTAASPWATLRTCRNTRRPRTPAPPPDL

SEQ ID NO: 817365 - protein, 210 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKCAWVRTHGALLGQPFEVAYGMHVGSRK

SEQ ID NO: 817366 - protein, 134 aa, Homo sapiens
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPKKAIPAGCGDEEEEEEESILDTVLKYLPGPLQDMFKK

SEQ ID NO: 817367 - protein, 134 aa, Homo sapiens; identical to SEQ ID NO: 817366

SEQ ID NO: 817368 - protein, 123 aa, Homo sapiens
MTHSSPAQHADLWPLTLSGPPGQGRGTEWPGSEEGSQGKPVPGRPRLRGPGSGQAGIWVGGWGSSSSISLVTPSPGAPPSPAPTWRDMAPAKLVPSNGSFVDFSSFVEEPQVGTPLVPHPHPT

SEQ ID NO: 817369 - protein, 134 aa, Homo sapiens; identical to SEQ ID NO: 817366

SEQ ID NO: 817370 - protein, 134 aa, Homo sapiens; identical to SEQ ID NO: 817366

SEQ ID NO: 817371 - protein, 134 aa, Homo sapiens; identical to SEQ ID NO: 817366

SEQ ID NO: 817372 - protein, 134 aa, Homo sapiens; identical to SEQ ID NO: 817366

SEQ ID NO: 817373 - protein, 104 aa, Homo sapiens [sequence omitted]

SEQ ID NO: 817374 - protein, 143 aa, Homo sapiens
SSWLTLEDTQLRGELPERSKKAAVDRPGLGTSDRSGSPNMDVLPSKSRSSQKVSLTAKLCRVLLQMESGSRDTIPGVCKRERENREDTEVLQPRSPIRGTAGGQSSHPTALWLEYSGVDPPAPIALVPSWQGCPPLLSTCSIL

SEQ ID NO: 817375 - protein, 134 aa, Homo sapiens; identical to SEQ ID NO: 817366

SEQ ID NO: 817376 - protein, 154 aa, Homo sapiens
MEQGKFGGRHVLRPGRPWPQPPCAVRGLWNPGGYRSIAAQIPYQGDSWWAKQPPHSLVARVQWGGPSSPNSPSTQLAGLPTPAVHLLHPLGFHRPLTAQGGWGQPGLPGLRTCLPPKCPLLQSHSCHPTLCTGEKTGGARAGPGWERGVLVRPR

SEQ ID NO: 817377 - protein, 122 aa, Homo sapiens
SRGSSGGLIPYQGDSWWAKQPPHSLVARVQWGGPSSPNSPSTQLAGLPTPAVHLLHPLGFHRPLTAQGGWGQPGLPGLRTCLPPKCPLLQSHSCHPTLCTGEKTGGARAGPGWERGVLVRPR

SEQ ID NO: 817378 - protein, 118 aa, Homo sapiens
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPGPFNASGPFNASGPFNASGPF

SEQ ID NO: 817379 - protein, 582 aa, Homo sapiens
MSIETLLEAARFLEWQAQQQQRAREEQERLRLEQEREQEQKKANSLARLAHTLPVEEPRMEAPPLPLSPPAPPPAPPPPLATPAPLTVIPIPVVTNSPQPLPPPPPLPAAAQPLPLAPRQPALVGAPGLSIKEPAPLPSRPQVPTPAPLLPDSKATIPPNGSPKPLQPLPTPVLTIAPHPGVQPQLAPQQPPPPTLGTLKLAPAEEVKSSEQKKRPGGIGTREVHNKLEKNRRAHLKECFETLKRNIPNVDDKKTSNLSVLRTALRYIQSLKRKEKEYEHEMERLAREKIATQQRLAELKHELSQWMDVLEIDRVLRQTGQPEDDQASTSTASEGEDNIDEDMEEDRAGLGPPKLSHRPQPELLKSTLPPPSTTPAPLPPHPHPHPHSVALPPAHLPVQQQQPQQKTPLPAPPPPPAAPAQTLVPAPAHLVATAGGGSTVIAHTATTHASVIQTVNHVLQGPGGKHIAHIAPSAPSPAVQLAPATPPIGHITVHPATLNHVAHLGSQLPLYPQPVAVSHIAHTLSHQQVNGTAGLGPPATVMAKPAVGAQVVHHPQLVGQTVLNPVTMVTMPSFPVSTLKLA

SEQ ID NO: 817380 - protein, 301 aa, Homo sapiens
MERLAREKIATQQRLAELKHELSQWMDVLEIDRVLRQTGQPEDDQASTSTASEGEDNIDEDMEEDRAGLGPPKLSHRPQPELLKSTLPPPSTTPAPLPPHPHPHPHSVALPPAHLPVQQQQPQQKTPLPAPPPPPAAPAQTLVPAPAHLVATAGGGSTVIAHTATTHASVIQTVNHVLQGPGGKHIAHIAPSAPSPAVQLAPATPPIGHITVHPATLNHVAHLGSQLPLYPQPVAVSHIAHTLSHQQVNGTAGLGPPATVMAKPAVGAQVVHHPQLVGQTVLNPVTMVTMPSFPVSTLKLA

SEQ ID NO: 817381 - protein, 582 aa, Homo sapiens; identical to SEQ ID NO: 817379

SEQ ID NO: 817382 - protein, 582 aa, Homo sapiens; identical to SEQ ID NO: 817379

SEQ ID NO: 817383 - protein, 97 aa, Homo sapiens
RPPPACAQRLTQPQSRQSANTVVPAPLFPWPCPPSPPLARSAFLPPTPTSRVRAIPGQETPWRRVGPNSSPAASRECRAPQPGPRPRQRLGQGLQNY

SEQ ID NO: 817384 - protein, 123 aa, Homo sapiens
RPPPACAQRLTQPQSRQSANTVVPAPLFPWPCPPSPPLARSAFLPPTPTSRVRAIPGQETPWRRVGPNSSPAASRECRAPQPGPRPRQRLGQDTEIEEERFWRSVGLWRELIRDCSLAELLSA

SEQ ID NO: 817385 - protein, 1442 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 817386 - protein, 1455 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKAFREGSRKSLRMKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 817387 - protein, 1461 aa, Homo sapiens
MSIAIPLGVTTSDTSYSDMAAGSDPESVEASPAVNEKSVYSTHNYGTTQRHGCRGLPYADHNYGAPPPPTPPASPPVQTIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 817388 - protein, 1442 aa, Homo sapiens; identical to SEQ ID NO: 817385

SEQ ID NO: 817389 - protein, 1571 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKEERHSLSSEELRWTWLTSVVVKIILFDKTLLGEKNHNSDKLTPVCYLERSASKSSNCSMYKMVTPPFQAKHSLLCACSLIKSRQTCCFPKFRRCKRLLLLLSAYASYLESWGGLLICVENYRNFNCIPRPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 817390 - protein, 1455 aa, Homo sapiens
ESKPAQSGFSRGNSPLSCPESVEASPAVNEKSVYSTHNYGTTQRHGCRGLPYADHNYGAPPPPTPPASPPVQTIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 817391 - protein, 1107 aa, Homo sapiens
MCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 817392 - protein, 992 aa, Homo sapiens
MEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 817393 - protein, 1442 aa, Homo sapiens; identical to SEQ ID NO: 817385

SEQ ID NO: 817394 - protein, 1560 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEVIAPGQMMMLWHQSSKGRGPGLPHGLSRGAIVTLSALYINVGLLCSYISFCFTKSKTSFAGFAPENEGLVIICVYHVASHELQFKALEIVIESFKLPELNRLIFSQSLSTAEYASILKEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 817395 - protein, 924 aa, Homo sapiens
MHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 817396 - protein, 1461 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFENISSPESSPAHRPESLSPELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 817397 - protein, 910 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELC

SEQ ID NO: 817398 - protein, 1242 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQVR

SEQ ID NO: 817399 - protein, 75 aa, Homo sapiens
STGTLSSTSFPQNSQVVIAIRLTDYQSAQCRADTATSSCSVIVLGQNHKASFSRVPPPSEDILHSLQDTVIELLH

SEQ ID NO: 817400 - protein, 787 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGAHSCFLPAASGT

SEQ ID NO: 817401 - protein, 1456 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTYLVLSSGFGTRPAFWWERG

SEQ ID NO: 817402 - protein, 931 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFEVIWVWLLGVLDMKIIICTFSFQI

SEQ ID NO: 817403 - protein, 803 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKIWIQAAFLSVCHCPPPLASRT

SEQ ID NO: 817404 - protein, 279 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQVSTKGLRTL

SEQ ID NO: 817405 - protein, 82 aa, Homo sapiens
ASIQRLSEAYEACSLSEAALLFLPVLFTGLLKQTCSEFLSLDWLFIGLLSASCFRLTCLMQFLLLKSVGIVHKTLFVCLLCE

SEQ ID NO: 817406 - protein, 642 aa, Homo sapiens
CVITSRGRRGQTRTAPEPPEPPGLGGASAPPEPPASPAPHSIPTGWGRARCGCVGSGAELQNPRTHFVLSPHCFMGGIMAPKDIMTNTHAKSILNSMNSLRKSNTLCDVTLRVEQKDFPAHRIVLAACSDYFCAMFTSELSEKGKPYVDIQGLTASTMEILLDFVYTETVHVTVENVQELLPAACLLQLKGVKQACCEFLESQLDPSNCLGIRDFAETHNCVDLMQAAEVFSQKHFPEVVQHEEFILLSQGEVEKLIKCDEIQVDSEEPVFEAVINWVKHAKKEREESLPNLLQYVRMPLLTPRYITDVIDAEPFIRCSLQCRDLVDEAKKFHLRPELRSQMQGPRTRARLGANEVLLVVGGFGSQQSPIDVVEKYDPKTQEWSFLPSITRKRRYVASVSLHDRIYVIGGYDGRSRLSSVECLDYTADEDGVWYSVAPMNVRRGLAGATTLGDMIYVSGGFDGSRRHTSMERYDPNIDQWSMLGDMQTAREGAGLVVASGVIYCLGGYDGLNILNSVEKYDPHTGHWTNVTPMATKRSGAGVALLNDHIYVVGGFDGTAHLSSVEAYNIRTDSWTTVTSMTTPRCYVGATVLRGRLYAIAGYDGNSLLSSIECYDPIIDSWEVVTSMGTQRCDAGVCVLREK

SEQ ID NO: 817407 - protein, 244 aa, Homo sapiens
PQCLTLLSAIFQPFIRCSLQCRDLVDEAKKFHLRPELRSQMQGPRTRARLGANEVLLVVGGFGSQQSPIDVVEKYDPKTQEWSFLPSITRKRRYVASVSLHDRIYVIGGYDGRSRLSSVECLDYTADEDGVWYSVAPMNVRRGLAGATTLGDMIYVSGGFDGSRRHTSMERYDPNIDQWSMLGDMQTAREGAGLVVASGVIYCLGGYDGLNILNSVEKYDPHTGHWTNVTPMATKRSDMMVIPC

SEQ ID NO: 817408 - protein, 642 aa, Homo sapiens; identical to SEQ ID NO: 817406

SEQ ID NO: 817409 - protein, 642 aa, Homo sapiens; identical to SEQ ID NO: 817406

SEQ ID NO: 817410 - protein, 642 aa, Homo sapiens; identical to SEQ ID NO: 817406

SEQ ID NO: 817411 - protein, 541 aa, Homo sapiens
CVITSRGRRGQTRTAPEPPEPPGLGGASAPPEPPASPAPHSIPTGWGRARCGCVGSGAELQNPRTHFVLSPHCFMGGIMAPKDIMTNTHAKSILNSMNSLRKSNTLCDVTLRVEQKDFPAHRIVLAACSDYFCAMFTSELSEKGKPYVDIQGLTASTMEILLDFVYTETVHVTVENVQELLPAACLLQLKGVKQACCEFLESQLDPSNCLGIRDFAETHNCVDLMQAAEVFSQKHFPEVVQHEEFILLSQGEVEKLIKCDEIQVDSEEPVFEAVINWVKHAKKEREESLPNLLQYVRMPLLTPRYITDVIDAEPFIRCSLQCRDLVDEAKKFHLRPELRSQMQGPRTRARLDMIYVSGGFDGSRRHTSMERYDPNIDQWSMLGDMQTAREGAGLVVASGVIYCLGGYDGLNILNSVEKYDPHTGHWTNVTPMATKRSGAGVALLNDHIYVVGGFDGTAHLSSVEAYNIRTDSWTTVTSMTTPRCYVGATVLRGRLYAIAGYDGNSLLSSIECYDPIIDSWEVVTSMGTQRCDAGVCVLREK

SEQ ID NO: 817412 - protein, 652 aa, Homo sapiens
AEYILRSVDPKAQRILAAALFGPKRPLWTMDVNKFEASVGFLDVKKFLSTWKKRGFAVIPRRVWNSGAQLQNPRTHFVLSPHCFMGGIMAPKDIMTNTHAKSILNSMNSLRKSNTLCDVTLRVEQKDFPAHRIVLAACSDYFCAMFTSELSEKGKPYVDIQGLTASTMEILLDFVYTETVHVTVENVQELLPAACLLQLKGVKQACCEFLESQLDPSNCLGIRDFAETHNCVDLMQAAEVFSQKHFPEVVQHEEFILLSQGEVEKLIKCDEIQVDSEEPVFEAVINWVKHAKKEREESLPNLLQYVRMPLLTPRYITDVIDAEPFIRCSLQCRDLVDEAKKFHLRPELRSQMQGPRTRARLGANEVLLVVGGFGSQQSPIDVVEKYDPKTQEWSFLPSITRKRRYVASVSLHDRIYVIGGYDGRSRLSSVECLDYTADEDGVWYSVAPMNVRRGLAGATTLGDMIYVSGGFDGSRRHTSMERYDPNIDQWSMLGDMQTAREGAGLVVASGVIYCLGGYDGLNILNSVEKYDPHTGHWTNVTPMATKRSGAGVALLNDHIYVVGGFDGTAHLSSVEAYNIRTDSWTTVTSMTTPRCYVGATVLRGRLYAIAGYDGNSLLSSIECYDPIIDSWEVVTSMGTQRCDAGVCVLREK

SEQ ID NO: 817413 - protein, 330 aa, Homo sapiens
CVITSRGRRGQTRTAPEPPEPPGLGGASAPPEPPASPAPHSIPTGWGRARCGCVGSGAELQNPRTHFVLSPHCFMGGIMAPKDIMTNTHAKSILNSMNSLRKSNTLCDVTLRVEQKDFPAHRIVLAACSDYFCAMFTSELSEKGKPYVDIQGLTASTMEILLDFVYTETVHVTVENVQELLPAACLLQLKGVKQACCEFLESQLDPSNCLGIRDFAETHNCVDLMQAAEVFSQKHFPEVVQHEEFILLSQGEVEKLIKCDEIQVDSEEPVFEAVINWVKHAKKEREESLPNLLQYVRMPLLTPRYITDVIDAECFGGDSMQLQDMMVIPC

SEQ ID NO: 817414 - protein, 302 aa, Homo sapiens
CVITSRGRRGQTRTAPEPPEPPGLGGASAPPEPPASPAPHSIPTGWGRARCGCVGSGAELQNPRTHFVLSPHCFMGGIMAPKDIMTNTHAKSILNSMNSLRKSNTLCDVTLRVEQKDFPAHRIVLAACSDYFCAMFTSELSEKGKPYVDIQGLTASTMEILLDFVYTETVHVTVENVQELLPAACLLQLKGVKQACCEFLESQLDPSNCLGIRDFAETHNCVDLMQAAEVFSQKHFPEVVQHEEFILLSQGEVEKLIKCDEIQDLALWFLHEDSGCGAWTYNTTSAVTVKSAIRRLKELKDQ

SEQ ID NO: 817415 - protein, 243 aa, Homo sapiens
MAKVEQVLSLEPQHELKFRGPFTDVVTTNLKLGNPTDRNVCFKVKTTAPRRYCVRPNSGIIDAGASINVSVMLQPFDYDPNEKSKHKFMVQSMFAPTDTSDMEAVWKEAKPEDLMDSKLRCVFELPAENDKPHDVEINKIISTTASKTETPIVSKSLSSSLDDTEVKKVMEECKRLQGEVQRLREENKQFKEEDGLRMRKTVQSNSPISALAPTGKEEGLSTRLLALVVLFFIVGVIIGKIAL

SEQ ID NO: 817416 - protein, 243 aa, Homo sapiens; identical to SEQ ID NO: 817415

SEQ ID NO: 817417 - protein, 243 aa, Homo sapiens; identical to SEQ ID NO: 817415

SEQ ID NO: 817418 - protein, 256 aa, Homo sapiens
RRHPPAPSPRRRNMAKVEQVLSLEPQHELKFRGPFTDVVTTNLKLGNPTDRNVCFKVKTTAPRRYCVRPNSGIIDAGASINVSVMLQPFDYDPNEKSKHKFMVQSMFAPTDTSDMEAVWKEAKPEDLMDSKLRCVFELPAENDKPHDVEINKIISTTASKTETPIVSKSLSSSLDDTEVKKVMEECKRLQGEVQRLREENKQFKEEDGLRMRKTVQSNSPISALAPTGKEEGLSTRLLALVVLFFIVGVIIGKIAL

SEQ ID NO: 817419 - protein, 243 aa, Homo sapiens; identical to SEQ ID NO: 817415

SEQ ID NO: 817420 - protein, 68 aa, Homo sapiens
PAPGAGGAGRSFPPPERASLLRACVCTTLRACVRACVPSARRAPRPRPRPPPLRLHRVDRPPPSAPTR

SEQ ID NO: 817421 - protein, 202 aa, Homo sapiens
MRKMVTCDGTQSSMARYPRQAAQAELTLQEHIEAIPSDRAEKAWCQHGGLLKRRCGPSMPNEILSTAIAHPSFSHNTNYPQLGLPRTSTFRCPSVLTSNHMLTLLRFCNIRDCSSRRMYAPVKCSRAPRMVDTVEVRAWPREASVIDRMPCIVDAPKIDDGAHCTPIGFTSPTGKEEGLSTRLLALVVLFFIVGVIIGKIAL

SEQ ID NO: 817422 - protein, 256 aa, Homo sapiens; identical to SEQ ID NO: 817418

SEQ ID NO: 817423 - protein, 68 aa, Homo sapiens; identical to SEQ ID NO: 817420

SEQ ID NO: 817424 - protein, 70 aa, Homo sapiens
RIINTEQYMHSFVGSAAHEVVLLLEGCGLLCLWRVWSCGGGVYWDAGEELPGSVFSGSVNNNCHREGNSQ

SEQ ID NO: 817425 - protein, 243 aa, Homo sapiens; identical to SEQ ID NO: 817415

SEQ ID NO: 817426 - protein, 388 aa, Homo sapiens
MAKVEQVLSLEPQHELKFRGPFTDVVTTNLKLGNPTDRNVCFKVKTTAPRRYCVRPNSGIIDAGASINVSVMLQPFDYDPNEKSKHKFMVQSMFAPTDTSDMEAVWKEAKPEDLMDSKLRCVFELPAENDKPTSDRAGGGGRGLAQRREQLNFKHKQLHERAPTAPEPCPDPRPPRPCGARAETPWPRRSSGRGPPSRRGPREGRSGAAPHRRRANLGSRFPARRGARGARSPAMSRSNRAEGVQMRGPGVRQDEGLPTLAGRIDEMPEAAVKSTAKKYKSCCRDHETASLGPENSSLTGIQEKWEATREGSARVWTSRKLLKSRHKLRKMVTPDKRSAGAKQDEGKREAGQRRENTGTKERSNQGTEEDTTQEHVTQNEKAHKQGNS

SEQ ID NO: 817427 - protein, 490 aa, Homo sapiens
MSEVTKNSLEKILPQLKCHFTWNLFKEDSVSRDLEDRVCNQIEFLNTEFKATMYNLLAYIKHLDGNNEAALECLRQAEELIQQEHADQAEIRSLVTWGNYAWVYYHLGRLSDAQIYVDKVKQTCKKFSNPYSIEYSELDCEEGWTQLKCGRNERAKVCFEKALEEKPNNPEFSSGLAIAMYHLDNHPEKQFSTDVLKQAIELSPDNQYVKVLLGLKLQKMNKEAEGEQFVEEALEKSPCQTDVLRSAAKFYRRKGDLDKAIELFQRVLESTPNNGYLYHQIGCCYKAKVRQMQNTGESEASGNKEMIEALKQYAMDYSNKALEKGLNPLNAYSDLAEFLETECYQTPFNKEVPDAEKQQSHQRYCNLQKYNGKSEDTAVQHGLEGLSISKKSTDKEEIKDQPQNVSENLLPQNAPNYWYLQGLIHKQNGDLLQAAKCYEKELGRLLRDAPSGIGSIFLSASELEDGSEEMGQGAVSSSPRELLSNSEQLN

SEQ ID NO: 817428 - protein, 490 aa, Homo sapiens; identical to SEQ ID NO: 817427

SEQ ID NO: 817429 - protein, 438 aa, Homo sapiens
MYNLLAYIKHLDGNNEAALECLRQAEELIQQEHADQAEIRSLVTWGNYAWVYYHLGRLSDAQIYVDKVKQTCKKFSNPYSIEYSELDCEEGWTQLKCGRNERAKVCFEKALEEKPNNPEFSSGLAIAMYHLDNHPEKQFSTDVLKQAIELSPDNQYVKVLLGLKLQKMNKEAEGEQFVEEALEKSPCQTDVLRSAAKFYRRKGDLDKAIELFQRVLESTPNNGYLYHQIGCCYKAKVRQMQNTGESEASGNKEMIEALKQYAMDYSNKALEKGLNPLNAYSDLAEFLETECYQTPFNKEVPDAEKQQSHQRYCNLQKYNGKSEDTAVQHGLEGLSISKKSTDKEEIKDQPQNVSENLLPQNAPNYWYLQGLIHKQNGDLLQAAKCYEKELGRLLRDAPSGIGSIFLSASELEDGSEEMGQGAVSSSPRELLSNSEQLN

SEQ ID NO: 817430 - protein, 311 aa, Homo sapiens
MYHLDNHPEKQFSTDVLKQAIELSPDNQYVKVLLGLKLQKMNKEAEGEQFVEEALEKSPCQTDVLRSAAKFYRRKGDLDKAIELFQRVLESTPNNGYLYHQIGCCYKAKVRQMQNTGESEASGNKEMIEALKQYAMDYSNKALEKGLNPLNAYSDLAEFLETECYQTPFNKEVPDAEKQQSHQRYCNLQKYNGKSEDTAVQHGLEGLSISKKSTDKEEIKDQPQNVSENLLPQNAPNYWYLQGLIHKQNGDLLQAAKCYEKELGRLLRDAPSGIGSIFLSASELEDGSEEMGQGAVSSSPRELLSNSEQLN

SEQ ID NO: 817431 - protein, 311 aa, Homo sapiens; identical to SEQ ID NO: 817430

SEQ ID NO: 817432 - protein, 271 aa, Homo sapiens
MNKEAEGEQFVEEALEKSPCQTDVLRSAAKFYRRKGDLDKAIELFQRVLESTPNNGYLYHQIGCCYKAKVRQMQNTGESEASGNKEMIEALKQYAMDYSNKALEKGLNPLNAYSDLAEFLETECYQTPFNKEVPDAEKQQSHQRYCNLQKYNGKSEDTAVQHGLEGLSISKKSTDKEEIKDQPQNVSENLLPQNAPNYWYLQGLIHKQNGDLLQAAKCYEKELGRLLRDAPSGIGSIFLSASELEDGSEEMGQGAVSSSPRELLSNSEQLN

SEQ ID NO: 817433 - protein, 490 aa, Homo sapiens; identical to SEQ ID NO: 817427

SEQ ID NO: 817434 - protein, 154 aa, Homo sapiens
GQGDQLGTCCGGPGEMMLVLGENVRNGGEEKRSYYGKSEDTAVQHGLEGLSISKKSTDKEEIKDQPQNVSENLLPQNAPNYWYLQGLIHKQNGDLLQAAKCYEKELGRLLRDAPSGIGSIFLSASELEDGSEEMGQGAVSSSPRELLSNSEQLN

SEQ ID NO: 817435 - protein, 845 aa, Homo sapiens
PRGNLWWREEFGSFRAGVESSWEPPRDFGGGSSLAAGMAGTVVLDDVELREAQRDYLDFLDDEEDQGIYQSKVRELISDNQYRLIVNVNDLRRKNEKRANRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKDEENNPLETEYGLSVYKDHQTITIQEMPEKAPAGQLPRSVDVILDDDLVDKAKPGDRVQVVGTYRCLPGKKGGYTSGTFRTVLIACNVKQMSKDAQPSFSAEDIAKIKKFSKTRSKDIFDQLAKSLAPSIHGHDYVKKAILCLLLGGVERDLENGSHIRGDINILLIGDPSVAKSQLLRYVLCTAPRAIPTTGRGSSGVGLTAAVTTDQETGERRLEAGAMVLADRGVVCIDEFDKMSDMDRTAIHEVMEQGRVTIAKAGIHARLNARCSVLAAANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 817436 - protein, 845 aa, Homo sapiens; identical to SEQ ID NO: 817435

SEQ ID NO: 817437 - protein, 870 aa, Homo sapiens
PRGNLWWREEFGSFRAGVESSWEPPRDFGGGSSLAAGMAGTVVLDDVELREAQRDYLDFLDDEEDQGIYQSKVRELISDNQYRLIVNVNDLRRKNEKRANRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKDEENNPLETEYGLSVYKDHQTITIQEMPEKAPAGQLPRSVDVILDDDLVDKAKPGDRVQVVGTYRCLPGKKGGYTSGTFRTVLIACNVKQMSKDAQPSFSAEDIAKIKKFSKTRSKDIFDQLAKSLAPSIHGHDYVKKAILCLLLGGVERDLENGSHIRGDINILLIGDPSVAKSQLLRYVLCTAPRAIPTTGRGSSGVGLTAAVTTDQETGERRLEAGAMVLADRGVVCIDEFDKMSDMDRTAIHEVMEQGRVTIAKAGIHARLNARCSVLAAANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRDGISPCCPGWSWTPGLKQSFYLSLPKGWDYRHKPLCLFDLILFNDCRVSMVEGIQGGPLGCVPGSSCAVNRHESPHRIHQPGQRRALLFS

SEQ ID NO: 817438 - protein, 828 aa, Homo sapiens
PRGNLWWREEFGSFRAGVESSWEPPRDFGGGSSLAAGMAGTVVLDDVELREAQRDYLDFLDDEEDQGIYQSKVRELISDNQYRLIVNVNDLRRKNEKRANRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKDHQTITIQEMPEKAPAGQLPRSVDVILDDDLVDKAKPGDRVQVVGTYRCLPGKKGGYTSGTFRTVLIACNVKQMSKDAQPSFSAEDIAKIKKFSKTRSKDIFDQLAKSLAPSIHGHDYVKKAILCLLLGGVERDLENGSHIRGDINILLIGDPSVAKSQLLRYVLCTAPRAIPTTGRGSSGVGLTAAVTTDQETGERRLEAGAMVLADRGVVCIDEFDKMSDMDRTAIHEVMEQGRVTIAKAGIHARLNARCSVLAAANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 817439 - protein, 845 aa, Homo sapiens; identical to SEQ ID NO: 817435

SEQ ID NO: 817440 - protein, 845 aa, Homo sapiens; identical to SEQ ID NO: 817435

SEQ ID NO: 817441 - protein, 836 aa, Homo sapiens
PRGNLWWREEFGSFRAGVESSWEPPRDFGGGSSLAAGMAGTVVLDDVELREAQRDYLDFLDDEEDQGIYQSKVRELISDNQYRLIVNVNDLRRKNEKRANRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKDEENNPLETEYGLSVYKDHQTITIQEMPEKAPAGQLPRSVDVILDDDLVDKAKPGDRVQVVGTYRCLPGKKGGYTSGTFRTVLIACNVKQMSKDAQPSFSAEDIAKIKKFSKTRSKDIFDQLAKSLAPSIHGHDYVKKAILCLLLGGVERDLENGSHIRGDINILLIGDPSVAKSQLLRYVLCTAPRAIPTTGRGSSGVGLTAAVTTDQETGERRLEAGAMVLADRGVVCIDEFDKMSDMDRTAIHEVMEQGRVTIAKAGIHARLNARCSVLAAANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQQC

SEQ ID NO: 817442 - protein, 845 aa, Homo sapiens; identical to SEQ ID NO: 817435

SEQ ID NO: 817443 - protein, 605 aa, Homo sapiens
MPEKAPAGQLPRSVDVILDDDLVDKAKPGDRVQVVGTYRCLPGKKGGYTSGTFRTVLIACNVKQMSKDAQPSFSAEDIAKIKKFSKTRSKDIFDQLAKSLAPSIHGHDYVKKAILCLLLGGVERDLENGSHIRGDINILLIGDPSVAKSQLLRYVLCTAPRAIPTTGRGSSGVGLTAAVTTDQETGERRLEAGAMVLADRGVVCIDEFDKMSDMDRTAIHEVMEQGRVTIAKAGIHARLNARCSVLAAANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 817444 - protein, 541 aa, Homo sapiens [sequence omitted]

SEQ ID NO: 817445 - protein, 541 aa, Homo sapiens [sequence omitted]

SEQ ID NO: 817446 - protein, 516 aa, Homo sapiens
PRGNLWWREEFGSFRAGVESSWEPPRDFGGGSSLAAGMAGTVVLDDVELREAQRDYLDFLDDEEDQGIYQSKVRELISDNQYRLIVNVNDLRRKNEKRANRLLNNAFEELVAFQRALKDFVASIDATYAKQYEEFYVGLEGSFGSKHVSPRTLTSCFLTANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 817447 - protein, 343 aa, Homo sapiens [sequence omitted]

SEQ ID NO: 817448 - protein, 291 aa, Homo sapiens
TRRSCHLQLQGQNVLINKDIRCTDDEFTHLYTLIVRPDNTYEEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 817449 - protein, 273 aa, Homo sapiens
MVSAAFMKKYIHLLLFLLGPMKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 817450 - protein, 172 aa, Homo sapiens
MGLNRPLRVMRLVCRGCLEKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 817451 - protein, 299 aa, Homo sapiens
PRGNLWWREEFGSFRAGVESSWEPPRDFGGGSSLAAGMAGTVVLDDVELREAQRDYLDFLDDEEDQGIYQSKVRELISDNQYRLIVNVNDLRRKNEKRANRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKDEENNPLETEYGLSVYKDHQTITIQEMPEKAPAGQLPRSVDVILDDDLVDKAKPGDRVQVVGTYRCLPGKKGGYTSGTFRMADGE

SEQ ID NO: 817452 - protein, 234 aa, Homo sapiens
PRGNLWWREEFGSFRAGVESSWEPPRDFGGGSSLAAGMAGTVVLDDVELREAQRDYLDFLDDEEDQGIYQSKVRELISDNQYRLIVNVNDLRRKNEKRANRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKVWEQVGIGKCFLLGVQIDLD

SEQ ID NO: 817453 - protein, 310 aa, Homo sapiens
RPCSSQFLRQPAGPGWRLLPVGERCRASRSQLLVMSYGPLDMYRNPGPSGPQLRDFSSIIQTCSGNIQRISQATAQIKNLMSQLGTKQDSSKLQENLQQLQHSTNQLAKETNELLKELGSLPLPLSTSEQRQQRLQKERLMNDFSAALNNFQAVQRRVSEKEKESIARARAGSRLSAEERQREEQLVSFDSHEEWNQMQSQEDEVAITEQDLELIKERETAIRQLEADILDVNQIFKDLAMMIHDQGDLIDSIEANVESSEVHVERATEQLQRAAYYQKKSRKKMCILVLVLSVIILILGLIIWLVYKTK

SEQ ID NO: 817454 - protein, 113 aa, Homo sapiens [sequence omitted]

SEQ ID NO: 817455 - protein, 333 aa, Homo sapiens
RPCSSQFLRQPAGPGWRLLPVGERCRASRSQLLVMSYGPLDMYRNPGPSGPQLRDFSSIIQTCSGNIQRISQATAQIKNLMSQLGTKQDSSKLQENLQQLQHSTNQLAKETNELLKELGSLPLPLSTSEQRQQRLQKERLMNDFSAALNNFQAVQRRVSEKEKESIARARAGSRLSAEERQREEQLVSFDSSLLLDMKNVALQDFIDSRGLEPCHEEWNQMQSQEDEVAITEQDLELIKERETAIRQLEADILDVNQIFKDLAMMIHDQGDLIDSIEANVESSEVHVERATEQLQRAAYYQKKSRKKMCILVLVLSVIILILGLIIWLVYKTK

SEQ ID NO: 817456 - protein, 310 aa, Homo sapiens; identical to SEQ ID NO: 817453

SEQ ID NO: 817457 - protein, 310 aa, Homo sapiens; identical to SEQ ID NO: 817453

SEQ ID NO: 817458 - protein, 211 aa, Homo sapiens
RPCSSQFLRQPAGPGWRLLPVGERCRASRSQLLVMSYGPLDMYRNPGPSGPQLRDFSSIIQTCSGNIQRISQATAQIKNLMSQLGTKQDSSKLQENLQQLQHSTNQLAKETNELLKELGSLPLPLSTSEQRQQRLQKERLMNDFSAALNNFQAVQRRVSEKEKESIARARAGSRLSAEERQREEQLVSFDSHEEWNQMQSQEDECLLKIPF

SEQ ID NO: 817459 - protein, 310 aa, Homo sapiens; identical to SEQ ID NO: 817453

SEQ ID NO: 817460 - protein, 310 aa, Homo sapiens; identical to SEQ ID NO: 817453

SEQ ID NO: 817461 - protein, 310 aa, Homo sapiens; identical to SEQ ID NO: 817453

SEQ ID NO: 817462 - protein, 50 aa, Homo sapiens
MNLAWILNGLEFVVVAKEVLLGGLNKPIHRKNKLTAKYSYNPEAQQSKRR

SEQ ID NO: 817463 - protein, 310 aa, Homo sapiens; identical to SEQ ID NO: 817453

SEQ ID NO: 817464 - protein, 310 aa, Homo sapiens; identical to SEQ ID NO: 817453

SEQ ID NO: 817465 - protein, 228 aa, Homo sapiens
RPCSSQFLRQPAGPGWRLLPVGERCRASRSQLLVMSYGPLDMYRNPGPSGPQLRDFSSIIQTCSGNIQRISQATAQIKNLMSQLGTKQDSSKLQENLQQLQHSTNQLAKETNELLKELGSLPLPLSTSEQRQQRLQKERLMNDFSAALNNFQAVQRRVSEKEKESIARARAGSRLSAEERQREEQLVSFDSHEEWNQMQSQEDEVAITEQDLELIKERETAIRQLEAA

SEQ ID NO: 817466 - protein, 277 aa, Homo sapiens
RPCSSQFLRQPAGPGWRLLPVGERCRASRSQLLVMSYGPLDMYRNPGPSGPQLRDFSSIIQTCSGNIQRISQATAQIKNLMSQLGTKQDSSKLQENLQQLQHSTNQLAKETNELLKELGSLPLPLSTSEQRQQRLQKERLMNDFSAALNNFQAVQRRVSEKEKESIARARAGSRLSAEERQREEQLVSFDSSLLLDMKNVALQDFIDSRGLEPCHEEWNQMQSQEDEVAITEQDLELIKERETAIRQLEADILDVNQIFKDLAMMIHDQGDLIGMYY

SEQ ID NO: 817467 - protein, 178 aa, Homo sapiens
RPCSSQFLRQPAGPGWRLLPVGERCRASRSQLLVMSYGPLDMYRNPGPSGPQLRDFSSIIQTCSGNIQRISQATAQIKNLMSQLGTKQDSSKLQENLQQLQHSTNQLAKETNELLKELGSLPLPLSTSEQRQQRLQKERLMNDFSAALNNFQAVQRRVSEKEKESIARARAGSRLSVS

SEQ ID NO: 817468 - protein, 284 aa, Homo sapiens
MEAIKKKMQMLKLDKENAIDRAEQAEADKKAAEDKCKQVEEELTHLQKKLKGTEDELDKYSEDLKDAQEKLELTEKKASDAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 817469 - protein, 248 aa, Homo sapiens
MAGLNSLEAVKRKIQALQQQADEAEDRAQGLQRELDGERERREKAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 817470 - protein, 248 aa, Homo sapiens; identical to SEQ ID NO: 817469

SEQ ID NO: 817471 - protein, 284 aa, Homo sapiens; identical to SEQ ID NO: 817468

SEQ ID NO: 817472 - protein, 248 aa, Homo sapiens; identical to SEQ ID NO: 817469

SEQ ID NO: 817473 - protein, 248 aa, Homo sapiens; identical to SEQ ID NO: 817469

SEQ ID NO: 817474 - protein, 248 aa, Homo sapiens; identical to SEQ ID NO: 817469

SEQ ID NO: 817475 - protein, 248 aa, Homo sapiens; identical to SEQ ID NO: 817469

SEQ ID NO: 817476 - protein, 248 aa, Homo sapiens; identical to SEQ ID NO: 817469

SEQ ID NO: 817477 - protein, 248 aa, Homo sapiens; identical to SEQ ID NO: 817469

SEQ ID NO: 817478 - protein, 248 aa, Homo sapiens; identical to SEQ ID NO: 817469

SEQ ID NO: 817479 - protein, 248 aa, Homo sapiens; identical to SEQ ID NO: 817469

SEQ ID NO: 817480 - protein, 240 aa, Homo sapiens
MEAIKKKMQMLKLDKENAIDRAEQAEADKKAAEDKCKQVEEELTHLQKKLKGTEDELDKYSEDLKDAQEKLELTEKKASDRGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 817481 - protein, 248 aa, Homo sapiens; identical to SEQ ID NO: 817469

SEQ ID NO: 817482 - protein, 248 aa, Homo sapiens; identical to SEQ ID NO: 817469

SEQ ID NO: 817483 - protein, 248 aa, Homo sapiens; identical to SEQ ID NO: 817469

SEQ ID NO: 817484 - protein, 80 aa, Homo sapiens
LKATEGTDVRHCRYGKGALEEQKRPSRSREGNKQADEDSQGTQNLFTSREIHIPKCGTQAVNVECLGNSHNYPHIVINRW

SEQ ID NO: 817485 - protein, 121 aa, Homo sapiens
MFQKTWGPTKALPTFLTIIQFLSCMDALVKVKIQPPFVALPTLHTFVWFFSTMGSLVGNSIVNLCKILSHILAHLNGFSATVGLAGCFKRHEAHLKLFPHSLQLYGFSPVWTIDAYKDLAY

SEQ ID NO: 817486 - protein, 121 aa, Homo sapiens; identical to SEQ ID NO: 817485

SEQ ID NO: 817487 - protein, 86 aa, Homo sapiens
GFACRSQADRYSTERLDYHSQNCLYPPPGASVYDSTEHLDYTPPNAEGKTLKISFFRGKRCHSEVPTGNESQSHERLPSGECELLS

SEQ ID NO: 817488 - protein, 121 aa, Homo sapiens; identical to SEQ ID NO: 817485

SEQ ID NO: 817489 - protein, 290 aa, Homo sapiens
GAIDAQTTASHKSSTHIKKQMSSYFVNSFCGRYPNGPDYQLHNYGDHSSVSEQFRDSASMHSGRYGYGYNGMDLSVGRSGSGHFGSGERARSYAASASAAPAEPRYSQPATSTHSPQPDPLPCSAVAPSPGSDSHHGGKNSLSNSSGASADAGSTHISSREGVGTASGAEEDAPASSEQASAQSEPSPAPPAQPQIYPWMRKLHISHDNIGGPEGKRARTAYTRYQTLELEKEFHFNRYLTRRRRIEIAHALCLSERQIKIWFQNRRMKWKKDNKLKSMSMAAAGGAFRP

SEQ ID NO: 817490 - protein, 99 aa, Homo sapiens
ALGRAPGSGQPSKAQRDNIGGPEGKRARTAYTRYQTLELEKEFHFNRYLTRRRRIEIAHALCLSERQIKIWFQNRRMKWKKDNKLKSMSMAAAGGAFRP

SEQ ID NO: 817491 - protein, 302 aa, Homo sapiens
RGLWEGGGVNLLGLGEAVWTKQVRSVAMFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSQDHDRIFQYGKSPQKPGRNGTGRAGE

SEQ ID NO: 817492 - protein, 106 aa, Homo sapiens
MAAHPNGQQQQGQGLVTMSGGAPIVTLGVSYWPAMGGGAAAPHPVQSASAEAEPSSELPLLLQVVTPSTKLTRSSSQSARMSTFVATPPALAPKSSEVLRTRQCCW

SEQ ID NO: 817493 - protein, 469 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817494 - protein, 507 aa, Homo sapiens
RLGTRPGVNRPRAGCGAPRVNLLGLGEAVWTKQVRSVAMFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817495 - protein, 504 aa, Homo sapiens
LIRSAIPVEAGCGAPRVNLLGLGEAVWTKQVRSVAMFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817496 - protein, 469 aa, Homo sapiens; identical to SEQ ID NO: 817493

SEQ ID NO: 817497 - protein, 469 aa, Homo sapiens; identical to SEQ ID NO: 817493

SEQ ID NO: 817498 - protein, 469 aa, Homo sapiens; identical to SEQ ID NO: 817493

SEQ ID NO: 817499 - protein, 469 aa, Homo sapiens; identical to SEQ ID NO: 817493

SEQ ID NO: 817500 - protein, 504 aa, Homo sapiens
MGGAGARGLAGCGAPRVNLLGLGEAVWTKQVRSVAMFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817501 - protein, 469 aa, Homo sapiens; identical to SEQ ID NO: 817493

SEQ ID NO: 817502 - protein, 471 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817503 - protein, 469 aa, Homo sapiens; identical to SEQ ID NO: 817493

SEQ ID NO: 817504 - protein, 496 aa, Homo sapiens
RGLWEGGGVNLLGLGEAVWTKQVRSVAMFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817505 - protein, 500 aa, Homo sapiens
GRVGRPTRRAPRVNLLGLGEAVWTKQVRSVAMFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817506 - protein, 469 aa, Homo sapiens; identical to SEQ ID NO: 817493

SEQ ID NO: 817507 - protein, 516 aa, Homo sapiens
SLGVPGTGRTVVGGMRRLVTDGARRAAIVNLLGLGEAVWTKQVRSVAMFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817508 - protein, 469 aa, Homo sapiens; identical to SEQ ID NO: 817493

SEQ ID NO: 817509 - protein, 521 aa, Homo sapiens
MTATGVRHRYPGTINFQVDTMSGVNYSCSPSFPMNLLGLGEAVWTKQVRSVAMFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817510 - protein, 454 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGPHVYFCGNTPSFGSKIIRGPEDQTVLLVTVPDFSATQTACLVNLRSLACQPISFSGFGAEDDDLGGLGLGP

SEQ ID NO: 817511 - protein, 435 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGPEDQTVLLVTVPDFSATQTACLVNLRSLACQPISFSGFGAEDDDLGGLGLGP

SEQ ID NO: 817512 - protein, 448 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817513 - protein, 428 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSPHVYFCGNTPSFGSKIIRGPEDQTVLLVTVPDFSATQTACLVNLRSLACQPISFSGFGAEDDDLGGLGLGP

SEQ ID NO: 817514 - protein, 396 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVSMVGPIGASATGEFERGGHWTGGLGDNKRTGGLKSGQAGLGPVATGERGRREKGHGE

SEQ ID NO: 817515 - protein, 559 aa, Homo sapiens
MTARLRLKTKTKTETTITEKHRHLLSGSSGGQKLKSRCQQDWLLLKARGEGPSWPPPWCSWACGRITPLCPSSHSLLSVCLSLCSHEDTWHPGPNHTQSPWSPVADSLFTVTVKSRGSLYLMFSPGKGQGPVIGLSWSAGQGLHGLCRAGGLLHLCVCTPRVPGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817516 - protein, 363 aa, Homo sapiens
IPPVSAFQHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817517 - protein, 287 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAALAPKSSEVLRTRQCCW

SEQ ID NO: 817518 - protein, 364 aa, Homo sapiens
VTADFLRVNRRSASWPRLLWAIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817519 - protein, 516 aa, Homo sapiens
MGGAGARGLAGCGAPRVNLLGLGEAVWTKQVRSVAMFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGREPNEKDVGDAGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817520 - protein, 571 aa, Homo sapiens
MTARLRLKTKTKTETTITEKHRHLLSGSSGGQKLKSRCQQDWLLLKARGEGPSWPPPWCSWACGRITPLCPSSHSLLSVCLSLCSHEDTWHPGPNHTQSPWSPVADSLFTVTVKSRGSLYLMFSPGKGQGPVIGLSWSAGQGLHGLCRAGGLLHLCVCTPRVPGSGVGVKKLCELQPEEKCCVVGTLFKAMPLQPSILREVSEEHNLLPQPPRSKYIHPDDELVLEDELQRIKLKGTIDVSKLVTGREPNEKDVGDAGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817521 - protein, 307 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKQIPHKKPSSRVEVKMRMNPRGEAPVPGRMPRVGPIKSQRPPGVPGPE

SEQ ID NO: 817522 - protein, 192 aa, Homo sapiens [sequence omitted]

SEQ ID NO: 817523 - protein, 273 aa, Homo sapiens
THASDPRVAHASGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817524 - protein, 346 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817525 - protein, 171 aa, Homo sapiens
MLDEILLQLSQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817526 - protein, 241 aa, Homo sapiens
MGQQLHLPAGGALLSSEPGTRLGLMASGLLFQAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817527 - protein, 296 aa, Homo sapiens
DAWAGQLGDEGEQCSAVTTSTSSWVPSRLSPPPPPGPGRTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817528 - protein, 165 aa, Homo sapiens
MFSEQAAQRAHTLLSPPSANNATFARVPVATYTKVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 817529 - protein, 194 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDR

SEQ ID NO: 817530 - protein, 210 aa, Homo sapiens
MGGAGARGLAGCGAPRVNLLGLGEAVWTKQVRSVAMFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGREPNERMWVMQVKSPAVVC

SEQ ID NO: 817531 - protein, 160 aa, Homo sapiens
MGGAGARGLAGCGAPRVNLLGLGEAVWTKQVRSVAMFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSK

SEQ ID NO: 817532 - protein, 185 aa, Homo sapiens
SGSCGDGRGRRAGIGGMRRAAREPPWPGRSCVDQASQQPLHPCMFPLATAYSTLQLVTNPYQATIDGVRVRFLGTSGQNVSDIFRYSSMEDHLEILEWTLRVRHISPTAPDTLGPHVYFCGNTPSFGSKIIRGPEDQTVLLVTVPDFSATQTACLVNLRSLACQPISFSGFGAEDDDLGGLGLGP

SEQ ID NO: 817533 - protein, 144 aa, Homo sapiens
MFSEEDRKSLLEQCHLGLDQKRRKYVVGELIWNFADFMTNQWLVNYQISVKCIPNLLFHQLKHYSIVKNMIQQYNRAEDSICLADSKPLPHQNVTNHVGKAVEELHEGHIGVLLNLTNNEGQQNQESRGLIGTPELVFQGSKVL

SEQ ID NO: 817534 - protein, 370 aa, Homo sapiens
MLPRRLLAAWLAGTRGGGLLALLANQCRFVTGLRVRRAQQIAQLYGRLYSESSRRVLLGRLWRRLHGRPGHASALMAALAGVFVWDEERIQEEELQRSINEMKRLEEMSNMFQSSGVQHHPPEPKAQTEGNEDSEGKEQRWEMVMDKKHFKLWRRPITGTHLYQYRVFGTYTDVTPRQFFNVQLDTEYRKKWDALVIKLEVIERDVVSGSEVLHWVTHFPYPMYSRDYVYVRRYSVDQENNMMVLVSRAVEHPSVPESPEFVRVRSYESQMVIRPHKSFDENGFDYLLTYSDNPQTVFPRYCVSWMVSSGMPDFLEKLHMATLKAKNMEIKVKDYISAKPLEMSSEAKATSQSSERKNEGSCGPARIEYA

SEQ ID NO: 817535 - protein, 147 aa, Homo sapiens
MLPRRLLAAWLAGTRGGGLLALLANQCRFVTGLRVRRAQQIAQLYGRLYSESSRRVLLGRLWRRLHGRPGHASALMAALAGVFVWDEERIQEEELQRSITADDPRAQNFNYVPAALESSTNPPEPPPNPKGTDHPQAPPARPRPADA

SEQ ID NO: 817536 - protein, 370 aa, Homo sapiens; identical to SEQ ID NO: 817534

SEQ ID NO: 817537 - protein, 365 aa, Homo sapiens
MLPRRLLAAWLAGTRGGGLLALLANQCRFVTGLRVRRAQQIAQLYGRLYSESSRRVLLGRLWRRLHGRPGHASALMAALAGVFVWDEERIQEEELQRSINEMKRLEEMSNMFQSSGVQHHPPEPKAQTEGNEDSEGKEQRWEMVMDKKHFKLWRRPITGTHLYQYRVFGTYTDVTPRQFFNVQLDTEYRKKWDALVIKLEVCVMQNTNPAPPFLQYPMYSRDYVYVRRYSVDQENNMMVLVSRAVEHPSVPESPEFVRVRSYESQMVIRPHKSFDENGFDYLLTYSDNPQTVFPRYCVSWMVSSGMPDFLEKLHMATLKAKNMEIKVKDYISAKPLEMSSEAKATSQSSERKNEGSCGPARIEYA

SEQ ID NO: 817538 - protein, 370 aa, Homo sapiens; identical to SEQ ID NO: 817534

SEQ ID NO: 817539 - protein, 357 aa, Homo sapiens
MLPRRLLALLANQCRFVTGLRVRRAQQIAQLYGRLYSESSRRVLLGRLWRRLHGRPGHASALMAALAGVFVWDEERIQEEELQRSINEMKRLEEMSNMFQSSGVQHHPPEPKAQTEGNEDSEGKEQRWEMVMDKKHFKLWRRPITGTHLYQYRVFGTYTDVTPRQFFNVQLDTEYRKKWDALVIKLEVIERDVVSGSEVLHWVTHFPYPMYSRDYVYVRRYSVDQENNMMVLVSRAVEHPSVPESPEFVRVRSYESQMVIRPHKSFDENGFDYLLTYSDNPQTVFPRYCVSWMVSSGMPDFLEKLHMATLKAKNMEIKVKDYISAKPLEMSSEAKATSQSSERKNEGSCGPARIEYA

SEQ ID NO: 817540 - protein, 370 aa, Homo sapiens; identical to SEQ ID NO: 817534

SEQ ID NO: 817541 - protein, 370 aa, Homo sapiens; identical to SEQ ID NO: 817534

SEQ ID NO: 817542 - protein, 370 aa, Homo sapiens; identical to SEQ ID NO: 817534

SEQ ID NO: 817543 - protein, 264 aa, Homo sapiens
MKRLEEMSNMFQSSGVQHHPPEPKAQTEGNEDSEGKEQRWEMVMDKKHFKLWRRPITGTHLYQYRVFGTYTDVTPRQFFNVQLDTEYRKKWDALVIKLEVCVMQNTNPAPPFLQYPMYSRDYVYVRRYSVDQENNMMVLVSRAVEHPSVPESPEFVRVRSYESQMVIRPHKSFDENGFDYLLTYSDNPQTVFPRYCVSWMVSSGMPDFLEKLHMATLKAKNMEIKVKDYISAKPLEMSSEAKATSQSSERKNEGSCGPARIEYA

SEQ ID NO: 817544 - protein, 209 aa, Homo sapiens
MSQYRVFGTYTDVTPRQFFNVQLDTEYRKKWDALVIKLEVIERDVVSGSEVLHWVTHFPYPMYSRDYVYVRRYSVDQENNMMVLVSRAVEHPSVPESPEFVRVRSYESQMVIRPHKSFDENGFDYLLTYSDNPQTVFPRYCVSWMVSSGMPDFLEKLHMATLKAKNMEIKVKDYISAKPLEMSSEAKATSQSSERKNEGSCGPARIEYA

SEQ ID NO: 817545 - protein, 166 aa, Homo sapiens
TAVLPVQDNSITDVPFYPMYSRDYVYVRRYSVDQENNMMVLVSRAVEHPSVPESPEFVRVRSYESQMVIRPHKSFDENGFDYLLTYSDNPQTVFPRYCVSWMVSSGMPDFLEKLHMATLKAKNMEIKVKDYISAKPLEMSSEAKATSQSSERKNEGSCGPARIEYA

SEQ ID NO: 817546 - protein, 370 aa, Homo sapiens; identical to SEQ ID NO: 817534

SEQ ID NO: 817547 - protein, 183 aa, Homo sapiens
MTPDKVTVAYNRDCCDRSLPVGVNLTSALVQLITTSSIIAGVVRSVHSVDQENNMMVLVSRAVEHPSVPESPEFVRVRSYESQMVIRPHKSFDENGFDYLLTYSDNPQTVFPRYCVSWMVSSGMPDFLEKLHMATLKAKNMEIKVKDYISAKPLEMSSEAKATSQSSERKNEGSCGPARIEYA

SEQ ID NO: 817548 - protein, 80 aa, Homo sapiens
STLEDTTARRPCVSWMVASGMPDFLEKLHMATLKAKNMEIKVKDYISAKPLEMSSEAKATSQSSERKNEGSCGPARIEYA

SEQ ID NO: 817549 - protein, 177 aa, Homo sapiens [sequence omitted]

SEQ ID NO: 817550 - protein, 102 aa, Homo sapiens
MLPRRLLAAWLAGTRGGGLLALLANQCRFVTGLRVRRAQQIAQLYGRLYSESSRRVLLGRLWRRLHGRPGHASALMAALAGVFVWDEERIQEEELQRRSIMR

SEQ ID NO: 817551 - protein, 113 aa, Homo sapiens
MLPRRLLAAWLAGTRGGGLLALLANQCRFVTGLRVRRAQQIAQLYGRLYSESSRRVLLGRLWRRLHGRPGHASALMAALAGVFVWDEERIQEEELQRVGAAASSFWAVGWGGL

SEQ ID NO: 817552 - protein, 147 aa, Homo sapiens; identical to SEQ ID NO: 817535

SEQ ID NO: 817553 - protein, 333 aa, Homo sapiens
SGAAAAGRTAPAHLGGRAGEARCASRVRGTMSDAGGGKKPPVDPQAGPGPGPGRAAGERGLSGSFPLVLKKLMENPPREARLDKEKGKEKLEEDEAAAASTMAVSASLMPPIWDKTIPYDGESFHLEYMDLDEFLLENGIPASPTHLAHNLLLPVAELEGKESASSSTASPPSSSTAIFQPSETVSSTESSLEKERETPSPIDPNCVEVDVNFNPDPADLVLSSVPGGELFNPRKHKFAEEDLKPQPMIKKAKKVFVPDEQKDEKYWTRRKKNNVAAKRSRDARRLKENQITIRAAFLEKENTALRTEVAELRKEVGKCKTIVSKYETKYGPL

SEQ ID NO: 817554 - protein, 333 aa, Homo sapiens; identical to SEQ ID NO: 817553

SEQ ID NO: 817555 - protein, 157 aa, Homo sapiens
MGENPSETVSSTESSLEKERETPSPIDPNCVEVDVNFNPDPADLVLSSVPGGELFNPRKHKFAEEDLKPQPMIKKAKKVFVPDEQKDEKYWTRRKKNNVAAKRSRDARRLKENQITIRAAFLEKENTALRTEVAELRKEVGKCKTIVSKYETKYGPL

SEQ ID NO: 817556 - protein, 90 aa, Homo sapiens
KKNTKQNIRLGRGRGLIGGDEKYWTRRKKNNVAAKRSRDARRLKENQITIRAAFLEKENTALRTEVAELRKEVGKCKTIVSKYETKYGPL

SEQ ID NO: 817557 - protein, 333 aa, Homo sapiens; identical to SEQ ID NO: 817553

SEQ ID NO: 817558 - protein, 3026 aa, Homo sapiens
MNLHQVLTGAVNPGDHCFSVGSIGDQRFTAYASGCDIVILGSDFERLQIIPGAKHGNIQVGCVDCSMQQGKIAASYGNVISIFEPVNLPKQKKNLELYSQWQKSGQFFLESIAHNITWDPTGSRLLTGSSYLQLWSNTNLEKPTEDENLNKTDLNFGDWKCIWHCKTASQVHLMKFSPDGEFFATAGKDDCLLKVWYNVENWRTAVTSPDGSSEKQSQGEIDFSFVYLAHPRAVNGFSWRKTSKYMPRASVCNVLLTCCKDNVCRLWVETFLPNDCLLYGGDCSHWTESINLTNNFKRNASSKERVQNALEVNLRHFRRGRRRSLALVAHTGYLPHQQDPHHVHRNTPLHANALCHFHIAASINPATDIPLLPSITSLSLNENEEKTGPFVVHWLNNKELHFTLSMEVFLQQLRKSFEQPSSEASVEDSNQADVKSDEETDDGVDDLKINPEKKELGCDKMVPNSSFTSLSSAAIDHQIEVLLSEWSKNADMLFSIHPMDGSLLVWHVDWLDEYQPGMFRQVQVSFVSRIPVAFPTGDANSLCKSIMMYACTKNVDLAIQQGKQKPSGLTRSTSMLISSGHNKSSNSLKLSIFTPNVMMISKHADGSLNQWLVSFAEESAFSTVLSISHKSRYCGHRFHLNDLACHSVLPLLLTTSHHNALRTPDVDNPEQPFDALNIEECSLTQQNKSTVDVAFQDPSAVYSELILWRVDPVGPLSFSGGVSELARINSLHVSAFSNVAWLPTLIPSYCLGAYCNSPSACFVASDGQYLRLYEAVIDAKKLLSELSNPEISKYVGEVFNIVSQQSTARPGCIIALDPITKLHGRKTQLLHVFEEDFILNNLEKKSLGKDSILSNAGSSPNGFSEKFYLIVIECTQDNRSLLHMWNLHLKSIPVSLDEKVDTKLSEAVWQPEEHYSSSPEKILSPFSQKYQACRANLQSTSRLTLFSEMVYSQELHLPEGVEIISIKPSAGHLSSSSIYPACSAPYLLATSCSDEKVRFWRCRVTDGESATSKNGKIDLAYIWEEWPLLIEDGLQSNSSITVPGRPVEVSCAHTNRLAVAYKQPASNSRSSQDFVMHVSIFECESTGGSCWVLQTIHLDELSTVLDSGISVDSNLVAYNKQDMYLSSKENITSNTKHLVHLDWMSREDGSHILTVGIGSKLFMYGPLAGKVQDQTGKETLAFPLWESTKVVPLSKFVLLRSVDLVSSVDGSPPFPVSLSWVRDGILVVGMDCEMHVYCQWQPSSKQEPVITDSYSGSTPSITSLIKQSNSSSGLHPPKKTLTRSMTSLAQKICGKKTAFDPSVDMEDSGLFEAAHVLSPTLPQYHPLQLLELMDLGKVRRAKAILSHLVKCIAGEVVALNEAESNHERRLRSLTISASGSTTRDPQAFNKAENTDYTEIDSVPPLPLYALLAADDDSCYSSLEKSSNESTLSKSNQLSKESYDELFQTQLLMTDTHMLETDEENTKPRVIDLSQYSPTYFGPEHAQVLSGHLLHSSLPGLSRMEQMSLMALADTIATTSTDIGESRDRSQGGETLDECGLKFLLAVRLHTFLTTSLPAYRAQLLHQGLSTSHFAWAFHSVAEEELLNMLPAMQKDDPTWSELRAMGVGWWVRNTRILRKCIEKVAKAAFYRKNDPLDAAIFYLAMKKKAVIWGLYRAEKNTRMTQFFGHNFEDERWRKAALKNAFSLLGKQRFEHSAAFFLLAGCLRDAIEVCLEKLNDIQLALVIARLYESEFDTSAAYKSILRKKVLGIDSPVSELCSLNINMHHDPFLRSMAYWILEDYSGALETLIKQPIRENDDQVLSASNPTVFNFYNYLRTHPLLLRRHFGSSDTFSTHMSLTGKSGLAGTINLSERRLFFTTASAHLKAGCPMLALEVLSKMPKVIKKTRPFYRASSFLDTSKDCSPSSPLKLDAREDKSSAVDWSQSLINGFGSSSEGSSEKQSNSTLSFDWSQPSVVFQDDSLELKWDSDNDEENEDVPISMKELKPLQRKTDKKLDDISSNYTESFSTLDENDLLNPSEDIIAVQLKFRACLKILTVELRTLSTGYEIDGGKLRYQLYHWLEKEVIALQRTCDFCSDAEELQSAFGRNEDEFGLNEDAEDLPHQTKVKQLRENFQEKRQWLLKYQSLLRMFLSYCILHGSHGGGLASVRMELILLLQESQQETSEPLFSSLLSEQTSVPLLFACTANAKTVVANPLLHLSNLTHDILHAIINFDSPPHPDIQSNKVYVMHTLAASLSACIYQCLCGSHNYSSFQTNQFTGMVYQTVLLPHRPSLKTGSLDEALTPNTSPAQWPGITCLIRLLNSSGEEAQSGLTVLLCEILTAVYLSLFIHGLATHSSNELFRIVAHPLNEKMWSAVFGGGAHVPSKEQTHSKTLPVSSLVEEGEKQNKRFRPSKMSCRESAPLTPSSAPVSQESLAVKEKFIPPELSIWDYFIAKPFLPSSQSRAEYDSEESLGSDDDDNDDDDDVLASDFHLQEHSNSNSYSWSLMRLAMVQLVLNNLKTFYPFAGHDLAELPVSSPLCHAVLKTLQCWEQVLLRRLEIHGGPPQNYIASHTAEESLSAGPAILRHKALLEPTNTPFKSKHHLALSVKRLWQYLVKQEEIQETFIKNIFTKKRCLNEIEADLGYPGGKARIIHKESDIITAFAVNKANRNCIAIASSHDVQELDVSGILATQVYTWVDDDIEVETKGSEDFLVIHARDDLTAVQGTTPYTHSNPGTPINMPWLGSTQTGRGASVMIKKAINNVRRMTSHPTLPYYLTGAQDGSVRMFEWGHSQQITCFRSGGNSRVTRMRFNYQGNKFGIVDADGYLSLYQTNWKCCPVTGSMPKPYLTWQCHNKTANDFVFVSSSSLIATAGLSTDNRNVCLWDTLVAPANSLVHAFTCHDSGATVLAYAPKHQLLISGGRKGFTYVFDLCQRQQRQLFQSHDSPVKAVAVDPTEEYFVTGSAEGNIKIWSLSTFGLLHTFVSEHARQSIFRNIGTGVMQIETGPANHIFSCGADGTMKMRILPDQFSPLNEVLKNDVKFML

SEQ ID NO: 817559 - protein, 3026 aa, Homo sapiens; identical to SEQ ID NO: 817558

SEQ ID NO: 817560 - protein, 345 aa, Homo sapiens
MNLHQVLTGAVNPGDHCFSVGSIGDQRFTAYASGCDIVILGSDFERLQIIPGAKHGNIQVGCVDCSMQQGKIAASYGNVISIFEPVNLPKQKKNLELYSQWQKSGQFFLESIAHNITWDPTGSRLLTGSSYLQLWSNTNLEKPTEDENLNKTDLNFGDWKCIWHCKTASQVHLMKFSPDGEFFATAGKDDCLLKVWYNVENWRTAVTSPDGSSEKQSQGEIDFSFVYLAHPRAVNGFSWRKTSNHDSPVKAVAVDPTEEYFVTGSAEGNIKIWSLSTFGLLHTFVSEHARQSIFRNIGTGVMQIETGPANHIFSCGADGTMKMRILPDQFSPLNEVLKNDVKFML

SEQ ID NO: 817561 - protein, 196 aa, Homo sapiens
MATSVLCCLRCCRDGGTGHIPLKEMPAVQLDTQHMGTDVVIVKNGRRICGTGGCLASAPLHQNKSYFEFKIQSTGIWGIGVATQKVNLNQIPLGRDMHSLVMRNDGALYHNNEEKNRLPANSLPQEGDVVGITYDHVELNVYLNGKNMHCPASGIRGTVYPVVYVDDSAILDCQFSEFYHTPPPGFEKILFEQQIF

SEQ ID NO: 817562 - protein, 196 aa, Homo sapiens; identical to SEQ ID NO: 817561

SEQ ID NO: 817563 - protein, 196 aa, Homo sapiens; identical to SEQ ID NO: 817561

SEQ ID NO: 817564 - protein, 196 aa, Homo sapiens; identical to SEQ ID NO: 817561

SEQ ID NO: 817565 - protein, 157 aa, Homo sapiens
MATSVLCCLRCCRDGGTGHIPLKEMPAVQLDTQHMGIWGIGVATQKVNLNQIPLGRDMHSLVMRNDGALYHNNEEKNRLPANSLPQEGDVVGITYDHVELNVYLNGKNMHCPASGIRGTVYPVVYVDDSAILDCQFSEFYHTPPPGFEKILFEQQIF

SEQ ID NO: 817566 - protein, 196 aa, Homo sapiens; identical to SEQ ID NO: 817561

SEQ ID NO: 817567 - protein, 157 aa, Homo sapiens; identical to SEQ ID NO: 817565

SEQ ID NO: 817568 - protein, 167 aa, Homo sapiens
MATSVLCCLRCCRDGGTGHIPLKEMPAVQLDTQHMGTDVVIVKNGRRICGTGGCLASAPLHQNKSYFEFKIQSTGIWGIGVATQKVNLNQIPLGRDMHSLVMRNDGALYHNNEEKNRLPANSLPQEGDVVLMTVQFWIASSVSFIIRLHLVLKKYYLNSKSSECICF

SEQ ID NO: 817569 - protein, 196 aa, Homo sapiens; identical to SEQ ID NO: 817561

SEQ ID NO: 817570 - protein, 99 aa, Homo sapiens
MDERNRQVTFTKRKFGLMKKAYELSVLCDCEIALIIFNSTNKLFQYASTDMDKVLLKYTEYNEPHESRTNSDIVEGERACVVSPKPPQAGEFGPPPATH

SEQ ID NO: 817571 - protein, 462 aa, Homo sapiens
MDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 817572 - protein, 454 aa, Homo sapiens
MDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 817573 - protein, 430 aa, Homo sapiens
MDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGDRTTTPSRYPQHTRHEAGRSPVDSLSSCSSSYDGSDREDHRNEFHSPIGLTRPSPDERESPSVKRMRLSEGWAT

SEQ ID NO: 817574 - protein, 452 aa, Homo sapiens
MDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 817575 - protein, 454 aa, Homo sapiens; identical to SEQ ID NO: 817572

SEQ ID NO: 817576 - protein, 465 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 817577 - protein, 452 aa, Homo sapiens; identical to SEQ ID NO: 817574

SEQ ID NO: 817578 - protein, 166 aa, Homo sapiens
MGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 817579 - protein, 462 aa, Homo sapiens; identical to SEQ ID NO: 817571

SEQ ID NO: 817580 - protein, 454 aa, Homo sapiens; identical to SEQ ID NO: 817572

SEQ ID NO: 817581 - protein, 449 aa, Homo sapiens
MDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLS

SEQ ID NO: 817582 - protein, 269 aa, Homo sapiens
MDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVVIQNYILNKY

SEQ ID NO: 817583 - protein, 114 aa, Homo sapiens
MDERNRQVTFTKRKFGLMKKAYELSVLCDCEIALIIFNSTNKLFQYASTDMDKVLLKYTEYNEPHESRTNSDIVEDVGSDGRFLRGYHQYAYDGKDYIALKEDLRSWTAADTMF

SEQ ID NO: 817584 - protein, 715 aa, Homo sapiens
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIGDQSSGKSSVLEALSGVALPRGSGIVTRCPLVLKLKKQPCEAWAGRISYRNTELELQDPGQVEKEIHKAQNVMAGNGRGISHELISLEITSPEVPDLTIIDLPGITRVAVDNQPRDIGLQIKALIKKYIQRQQTINLVVVPCNVDIATTEALSMAHEVDPEGDRTIGILTKPDLMDRGTEKSVMNVVRNLTYPLKKGYMIVKCRGQQEITNRLSLAEATKKEITFFQTHPYFRVLLEEGSATVPRLAERLTTELIMHIQKSLPLLEGQIRESHQKATEELRRCGADIPSQEADKMFFLIEKIKMFNQDIEKLVEGEEVVRENETRLYNKIREDFKNWVGILATNTQKVKNIIHEEVEKYEKQYRGKELLGFVNYKTFEIIVHQYIQQLVEPALSMLQKAMEIIQQAFINVAKKHFGEFFNLNQTVQSTIEDIKVKHTAKAENMIQLQFRMEQMVFCQDQIYSVVLKKVREEIFNPLGTPSQNMKLNSHFPSNESSVSSFTEIGIHLNAYFLETSKRLANQIPFIIQYFMLRENGDSLQKAMMQILQEKNRYSWLLQEQSETATKRRILKERIYRLTQARHALCQFSSKEIH

SEQ ID NO: 817585 - protein, 111 aa, Homo sapiens
MCASRNSMPSLCNHRPWAETTPANPSFSLFQETSKRLANQIPFIIQYFMLRENGDSLQKAMMQILQEKNRYSWLLQEQSETATKRRILKERIYRLTQARHALCQFSSKEIH

SEQ ID NO: 817586 - protein, 102 aa, Homo sapiens
RGSPLFAFFMEIGIHLYMPTYLETSKRLANQIPFIIQYFMLRENGDSLQKAMMQILQEKNRYSWLLQEQSETATKRRILKERIYRLTQARHALCQFSSKEIH

SEQ ID NO: 817587 - protein, 715 aa, Homo sapiens; identical to SEQ ID NO: 817584

SEQ ID NO: 817588 - protein, 553 aa, Homo sapiens
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIGDQSSGKSSVLEALSGVALPRGSGIVTRCPLVLKLKKQPCEAWAGRISYRNTELELQDPGQVEKEIHKAQNVMAGNGRGISHELISLEITSPEVPDLTIIDLPGITRVAVDNQPRDIGLQIKALIKKYIQRQQTINLVVVPCNVDIATTEALSMAHEVDPEGDRTIGILTKPDLMDRGTEKSVMNVVRNLTYPLKKGYMIVKCRGQQEITNRLSLAEATKKEITFFQTHPYFRVLLEEGSATVPRLAERLTTELIMHIQKSLPLLEGQIRESHQKATEELRRCGADIPSQEADKMFFLIEKIKMFNQDIEKLVEGEEVVRENETRLYNKIREDFKNWVGILATNTQKGKFWAGLPAKQGGIYPDQRLCPAHDKCAKSGTRPSKTVEPLVISNCLSTNKTQKYGASTSATQHRAIPLPLMSSCLDFVLFC

SEQ ID NO: 817589 - protein, 196 aa, Homo sapiens
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIGDQSSGKSSVLEALSGVALPRGSGIVTRCPLVLKLKKQPCEAWAGRISYRNTELELQDPGQVEKEIHKDKIK

SEQ ID NO: 817590 - protein, 37 aa, Homo sapiens
MGRMTSNDALILISGTCERAVTRQRGVKATNGIKFAN

SEQ ID NO: 817591 - protein, 102 aa, Homo sapiens
DGVGNLIPLMNQLSQRQRAMRKDPVVPVKKRTHEGLLPPVENHPLPLCVCDSVYVTASDFCESCSATNVLPPDVSPDPQQAHISPRDDQFYAYCVLLIPWLW

SEQ ID NO: 817592 - protein, 102 aa, Homo sapiens; identical to SEQ ID NO: 817591

SEQ ID NO: 817593 - protein, 102 aa, Homo sapiens; identical to SEQ ID NO: 817591

SEQ ID NO: 817594 - protein, 102 aa, Homo sapiens; identical to SEQ ID NO: 817591

SEQ ID NO: 817595 - protein, 102 aa, Homo sapiens; identical to SEQ ID NO: 817591

SEQ ID NO: 817596 - protein, 102 aa, Homo sapiens; identical to SEQ ID NO: 817591

SEQ ID NO: 817597 - protein, 489 aa, Homo sapiens
MPPRTLLCAPKIPRRGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 817598 - protein, 489 aa, Homo sapiens; identical to SEQ ID NO: 817597

SEQ ID NO: 817599 - protein, 208 aa, Homo sapiens
MPPRTLLCAPKIPRRGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEVGLRLVRLWLDTHTSLALCS

SEQ ID NO: 817600 - protein, 489 aa, Homo sapiens; identical to SEQ ID NO: 817597

SEQ ID NO: 817601 - protein, 578 aa, Homo sapiens
LASPSLPRVGRTLQTSEQTLLISAARCSEAFQQPTSGRLLFFPFLKNNVYCFYFLSANVIYTYYRKFRKYRERKVRKLRSHTIFHHPERTTISILDGAPKIPRRGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 817602 - protein, 471 aa, Homo sapiens
MPPRTLLCAPKIPRRGQLLSELFTNRKENIPLKLSEDCLYLNIYTPADLTKKNRLPVMVWIHGGGLMVGAASTYDGLALAAHDTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 817603 - protein, 286 aa, Homo sapiens
MVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 817604 - protein, 237 aa, Homo sapiens
ASCSRVSRFRVISVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 817605 - protein, 234 aa, Homo sapiens
LEYLVYEIYSVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 817606 - protein, 235 aa, Homo sapiens
LCIPGYTRMYSVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 817607 - protein, 204 aa, Homo sapiens
MSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 817608 - protein, 256 aa, Homo sapiens
MPPRTLLCAPKIPRRGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPREMLEHPPTCMSFSTVQASHQT

SEQ ID NO: 817609 - protein, 519 aa, Homo sapiens
MPPRTLLCAPKIPRRGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKVLGQLCSQWKPQWGRAAPLARVQPEGRVSADWCQHPGGPEAEGQRSSFLDQPLCQEGSGEATPDRTHRAVNEDPAGLGSLEEQRLGSFAKGIAGSEGILPWLGNCLVVGGRGQRP

SEQ ID NO: 817610 - protein, 445 aa, Homo sapiens
MPPRTLLCAPKIPRRGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHREGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 817611 - protein, 384 aa, Homo sapiens
MPPRTLLCAPKIPRRGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDLARW

SEQ ID NO: 817612 - protein, 230 aa, Homo sapiens
GSVSCVNSVWTEQIRGLSSSLRPRSDVLSACDLQEFGWLIPMQLMSYPLSEGQLDQKTAMSLLWKSYPLVCIAKELIPEATEKYLGGTDDTVTVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 817613 - protein, 314 aa, Homo sapiens
MPPRTLLCAPKIPRRGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVVRV

SEQ ID NO: 817614 - protein, 68 aa, Homo sapiens
AAAYYYYCSIQASNDVRGMVVTAKPGTVPQHLLEAAGTGGKVARLEAVSVSSTAPSGSRPPQDTQGPP

SEQ ID NO: 817615 - protein, 1704 aa, Homo sapiens
MAVLRQLALLLWKNYTLQKRKVLVTVLELFLPLLFSGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPREPTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKANMAAAFGGFLYFFTYIPYFFVAPRYNWMTLSQKLCSCLLSNVAMAMGAQLIGKFEAKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALEEFKAFVDLTFPGSVLEDEHQGMVHYHLPGRDLSWAKVFGILEKAKEKYGVDDYSVSQISLEQVFLSFAHLQPPTAEEGR

SEQ ID NO: 817616 - protein, 134 aa, Homo sapiens
YYMVQMQKPLSIPFPEGNDVSGVSFYVYVYTQQNVRWSGSASRQEPCISLRPLSLQLKGLSRQKCPEEVKQMLHIIGLEDKWNSRSRFLSGGMRRKLSIGIALIAGSKVRRWDWRQWVPLLLDLGLQAPATTPG

SEQ ID NO: 817617 - protein, 162 aa, Homo sapiens
ESKQCSESKQCPESKQCPESKQCPESKQCPESKQCPSWDSLGLSLSSAFSTAVPRSPGTEAAWLCASSVSAGCCFARHKQNKLTAVCFPPSPPIGVGSQGRLQGRRKKTVTPRKHSETSTLKPSQRTWWRGSRSSTCPRCRLLWGQGGPGLPGPWEDLPARQ

SEQ ID NO: 817618 - protein, 132 aa, Homo sapiens
MGSSDQRRAVRRHTGCSRGLQAARSCQCRRNCEAGADARVAEGGDPCERARAPAAAPRRPGSVLESHACEPWAPPDVLRGHGVPKPQGCPAPLQRLSGPTPEPSVRSRLLLASSPVVLKGDLLCGASSGTQP

SEQ ID NO: 817619 - protein, 1664 aa, Homo sapiens
MAVLRQLALLLWKNYTLQKRKVLVTVLELFLPLLFSGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPREPTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKANMAAAFGGFLYFFTYIPYFFVAPRYNWMTLSQKLCSCLLSNVAMAMGAQLIGKFEAKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALEEFKAFVDLTFPGSVLEDEHQGMVHYHLPGRDLSWAKVFGILEKAKEKYGVDDYSVSQISLEQVFLSFAHLQPPTAEEGR

SEQ ID NO: 817620 - protein, 1558 aa, Homo sapiens
GPVFNATGTAALGQRPYMWTQTGSFFLKETEGWHTTSLFPLFPNPGPREPTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKANMAAAFGGFLYFFTYIPYFFVAPRYNWMTLSQKLCSCLLSNVAMAMGAQLIGKFEAKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALEEFKAFVDLTFPGSVLEDEHQGMVHYHLPGRDLSWAKVFGILEKAKEKYGVDDYSVSQISLEQVFLSFAHLQPPTAEEGR

SEQ ID NO: 817621 - protein, 1445 aa, Homo sapiens
MAVLRQLALLLWKNYTLQKRKVLVTVLELFLPLLFSGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPREPTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKANMAAAFGGFLYFFTYIPYFFVAPRYNWMTLSQKLCSCLLSNVAMAMGAQLIGKFEAKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFSVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALPGERTQ

SEQ ID NO: 817622 - protein, 121 aa, Homo sapiens
MHRMDECSPALMPRISMRISMSAYSGVHFPRAGAGRAVCGQAPGSLGGELTQEGLQLSWGLNFSRHSLERGPSDLSKFTHDTNLPWGGSGKPARLNCSEAPRPPGMDHADHCQWREAADCD

SEQ ID NO: 817623 - protein, 1587 aa, Homo sapiens
MAVLRQLALLLWKNYTLQKRKVLVTVLELFLPLLFSGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPREPTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKANMAAAFGGFLYFFTYIPYFFVAPRYNWMTLSQKLCSCLLSNVAMAMGAQLIGKFEAKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSQKHGEGVRALVATRGW

SEQ ID NO: 817624 - protein, 166 aa, Homo sapiens
MAVLRQLALLLWKNYTLQKRKVLVTVLELFLPLLFSGILIWLRLKIQSENVPNATIYPGQSIQELPLFFTFPPPGDTWELAYIPSHSDAAKTVTETVRRALVINMRVRGVGCSLAWGSDLCSLCLSFPICEMGTIMEPTSKGCYGNTLGGCLQSAGNAALDAVGYR

SEQ ID NO: 817625 - protein, 43 aa, Homo sapiens
MRGFPSEKDFEDYIRYDNCSSSVLAAVVFEHPFNHSKEPLPLA

SEQ ID NO: 817626 - protein, 456 aa, Homo sapiens
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILASQ

SEQ ID NO: 817627 - protein, 187 aa, Homo sapiens
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGALYPYKAPRAQPQPGAAPATTGPPYKAPQDQPKVPRAEASWVRCTPSLGLSEERHPR

SEQ ID NO: 817628 - protein, 90 aa, Homo sapiens
MNSSDEEKQLQLITSLKEQAIGEYEDLRAENQKTKEKCDKIRQERDEAVKKLEEFQKIYHMVIAEVNLMPPHTHVPKCRCCINKSVDLLP

SEQ ID NO: 817629 - protein, 631 aa, Homo sapiens
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENVRETDSSNC

SEQ ID NO: 817630 - protein, 664 aa, Homo sapiens
PLVINEHMLWGNRSARDEENASSAVHYQSEQSKMRKLILGEIKWFASKGPLATIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENVRETDSSNC

SEQ ID NO: 817631 - protein, 571 aa, Homo sapiens
MVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENVRETDSSNC

SEQ ID NO: 817632 - protein, 571 aa, Homo sapiens; identical to SEQ ID NO: 817631

SEQ ID NO: 817633 - protein, 631 aa, Homo sapiens; identical to SEQ ID NO: 817629

SEQ ID NO: 817634 - protein, 631 aa, Homo sapiens; identical to SEQ ID NO: 817629

SEQ ID NO: 817635 - protein, 631 aa, Homo sapiens; identical to SEQ ID NO: 817629

SEQ ID NO: 817636 - protein, 631 aa, Homo sapiens; identical to SEQ ID NO: 817629

SEQ ID NO: 817637 - protein, 631 aa, Homo sapiens; identical to SEQ ID NO: 817629

SEQ ID NO: 817638 - protein, 628 aa, Homo sapiens
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENVREHHC

SEQ ID NO: 817639 - protein, 342 aa, Homo sapiens
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSGKSIE

SEQ ID NO: 817640 - protein, 188 aa, Homo sapiens
MAGLSRQLCALSHPKKAAETQTAEPGGAHAVCSRHPVRVKGLEGSEMESARENIDLQPGSSDPRSQPINLNHYATKKSVAESMLDVALFMSNAMRLKAVLEQGPSSHYYTTLVTLISLSLLLQVVIGVLLVVIARLNLNEVEKQWRLNQLNNAATILVFFTVVINVFITAFGAHKTGFLAARASRNPL

SEQ ID NO: 817641 - protein, 188 aa, Homo sapiens; identical to SEQ ID NO: 817640

SEQ ID NO: 817642 - protein, 135 aa, Homo sapiens
MLDVALFMSNAMRLKAVLEQGPSSHYYTTLVTLISLSLLLQVVIGVLLVVIGEEPSLQSDLLPRHPWLAERPHVSPGPPCIGTGSFGNHTLTCSEPSANRGPKTNFHPARAGALSCLLVSHGADPPQYLLNDCAS

SEQ ID NO: 817643 - protein, 106 aa, Homo sapiens
MLDVALFMSNAMRLKAVLEQGPSSHYYTTLVTLISLSLLLQVVIGVLLVVIARLNLNEVEKQWRLNQLNNAATILVFFTVVINVFITAFGAHKTGFLAARASRNPL

SEQ ID NO: 817644 - protein, 156 aa, Homo sapiens
MSLSLSVILLYRHGIADTNSRQEKAPGSSDPRSQPINLNHYATKKSVAESMLDVALFMSNAMRLKAVLEQGPSSHYYTTLVTLISLSLLLQVVIGVLLVVIARLNLNEVEKQWRLNQLNNAATILVFFTVVINVFITAFGAHKTGFLAARASRNPL

SEQ ID NO: 817645 - protein, 134 aa, Homo sapiens
MYMPGSSDPRSQPINLNHYATKKSVAESMLDVALFMSNAMRLKAVLEQGPSSHYYTTLVTLISLSLLLQVVIGVLLVVIARLNLNEVEKQWRLNQLNNAATILVFFTVVINVFITAFGAHKTGFLAARASRNPL

SEQ ID NO: 817646 - protein, 822 aa, Homo sapiens
MLLTAVQLLYSPESSVRTKLIQLPVVYVMLMQHSLFLPTLLTSDGEESPDSQVKEALVDLMLTVVEMCPSVCESSHFAVLLGAYGATLSVLDQKILLLLRAYEQNKLSLINFRVLLWGPAAVEHHKTCRSLGRSLWQQPSVGDILRLLDRDRMMQTILHFPQNRRLLPPEDTQELIFKDKSRVDLDGLYDPCFLLQLFSELTRPEFVVDCRKFLDSNALGLTVTALSSYDPQMRAIAYHVLAAYYSHLEGARFQEQSQLLYLLDVVRNGIRTQDMRLTFTLALFIAKAALQILKPEEHMYLKVSNFLLSHEYLNMDKVPGFYQFFYSSDFEQKTEQKWVFGLLRQGIRDKQCYELCARRGIFHIILSFFHSPLCDEAAQNWILEILQNAAQVARSAYEIIRDYSLLTWILHILESKFLETPLLSNVISLLHTLWVTNLGDKAVEWESQRLCQPSSQEPAKRLALHLVNEFLYVLIVLMKHLRPTLAPVQLTNFFGTLDSVLRYRATVIQAFRDMNRFTVNETVLSTKDVLVLLHKWSLIERDLKLQEDLRAAIEKAQARELMKMLKDKNKPVMPARAKGPRGRKRRPGEAEEMADPELMASTLETCKGLLRSILTYWRPVIPGPDPTQEPVDSASPESDAPGPVYAAASLAVSWVLRSVAEHPLSRAEAAGLIGWLKSHILPHPVVVADLLKDSAVRSSIFRLYSRLCGAEGLAGPVQEVACLFNTVMLQLVAAQGRAGSPFHPAMEALSLSSLSEKDEATQASAAFLVSLYIKDIWLGAQRPDTLLTHVRMVCEAADDAPSSEEEAIVVLCKDAASAASDA

SEQ ID NO: 817647 - protein, 2248 aa, Homo sapiens
RARKEELTGVRFKAQLKDPQGPGPGLEAFVSAAKKLPREDVYDVVEGYIKISVECVEIFQLLSGEKRPESETMLIFQVFEAILLRTASDLSHFHVVGTNIVKKLMNNHMKLICESLYASGYRLARACLSLMTAMVTQGPEAARDVCSHFDLNKKTLYTLVTKRDSKGVYDVRQAYVQFALSFLIAGDDSTIVQVLEVKEFIPCIFSSGIKEDRISTINILLSTLKTKVVHNKNITKTQKVRFFTGQLLNHIASLYNWNGITDVNPENVKVSAEEAGKTMVRELVHNFLMDLCCSLKHGINFYDASLGTFGRGGNLTLLHFLLGLKTAADDDLVADLVVNILKVCPDLLNKYFKEVTFSFIPRAKSTWLNNIKLLNKIYEAQPEISRAFQTREFIPLPRLLAMVMVTTVPLVCNKSMFTQALNLDSTSVRHTALSLISVILKRALKTVDHCLNKEVWQESGVYTAVMMEEFVQLFREALSKILPDLNTVVWVWQSLKKQETKQDDKKGQKRSDGPPAACDAHQCDDAETILLKAVLLQVICLYQKVVPHVVMQYNFDFSKLLKGVISEQGLREEVPPILQHHMLKVALELPASKFLWLKAQEGPDAEIIGGERSVFYLLMKMFVTSSHLQLKSLTKLLIMKILRDTGVFEHTWKELELWLEHLENTMEEDKETVIQFLERILLTLVANPYSYTDKASDFVQEASMLQATMTKQEADDMSIPISHIDDVLDMVDVLVEGSEGLDEEIGFTLSEDMILLTFPFSAVVPAALEARNKLLLGTGNEAAENVVTYLTAVLTDLLHTQRDPLALCLLLQAYDKLEPPCLVPCCQQLSRFNRYYSLWIPEQAREAWLLQAQGSPSPPALPLASSFTALLQAAYESQALRDEHIQVQLQATMPHLSMQQVLLAAKQVLLYLRSTVENFGQLGRSVGPPLLQLFLDLLRRLVVHCEQLDAQNQQRCEAARAEADLFLDMESVASLELANDQTLEEVLVAILRHPTLEGWFLALEQQALPPHTLSPVLVKLLATHFSAGVLQLLAASAPILQNIGQLGLLARYSEAITQSVLKELQNRRAGPATSPPKTPPQLEALQELHPYMEGAQLREVTLALLSLPETHLVTQQPTKSPGKERHLNALGKTLVQLLTCSPQDQLQSGELLWSSEYVRGLGALLPTLAVDELDTVLLHTLQRDPVLAPAVGADLLDYCLARRTQAALSIAALLLQESCTHLLWFEQWCLQAGPGLGLQGDLDDFLPLIHVYLQCRTRSHFTRPAGVSSAVIPVLRKTLWRQLQSRLLSTDSPPASGLYQEILAQLVPFARAKDLSVLMDRLPSLLHTPSSHKRWIVADSISAALEGSAEELCAWRRTLLESCVKWLIVSFSGGQQDDDNTQNQEKEMLLRLNALLHALNEVDPGDWQKFVKKGLKFRYQDHTFLKMLLTAVQLLYSPESSVRTKLIQLPVVYVMLMQHSLFLPTLLTSDGEESPDSQVKEALVDLMLTVVEMCPSVCESSHFAVLLGAYGATLSVLDQKILLLLRAYEQNKLSLINFRVLLWGPAAVEHHKTCRSLGRSLWQQPSVGDILRLLDRDRMMQTILHFPQNRRLLPPEDTQELIFKDKSRVDLDGLYDPCFLLQLFSELTRPEFVVDCRKFLDSNALGLTVTALSSYDPQMRAIAYHVLAAYYSHLEGARFQEQSQLLYLLDVVRNGIRTQDMRLTFTLALFIAKAALQILKPEEHMYLKVSNFLLSHEYLNMDKVPGFYQFFYSSDFEQKTEQKWVFGLLRQGIRDKQCYELCARRGIFHIILSFFHSPLCDEAAQNWILEILQNAAQVARSAYEIIRDYSLLTWILHILESKFLETPLLSNVISLLHTLWVTNLGDKAVEWESQRLCQPSSQEPAKRLALHLVNEFLYVLIVLMKHLRPTLAPVQLTNFFGTLDSVLRYRATVIQAFRDMNRFTVNETVLSTKDVLVLLHKWSLIERDLKLQEDLRAAIEKAQARELMKMLKDKNKPVMPARAKGPRGRKRRPGEAEEMADPELMASTLETCKGLLRSILTYWRPVIPGPDPTQEPVDSASPESDAPGPVYAAASLAVSWVLRSVAEHPLSRAEAAGLIGWLKSHILPHPVVVADLLKDSAVRSSIFRLYSRLCGAEGLAGPVQEVACLFNTVMLQLVAAQGRAGSPFHPAMEALSLSSLSEKDEATQASAAFLVSLYIKDIWLGAQRPDTLLTHVRMVCEAADDAPSSEEEAIVVLCKDAASAASDA

SEQ ID NO: 817648 - protein, 796 aa, Homo sapiens
MLPGRLSPLLVFSVSAPPCHVFQGCFLAEALVDLMLTVVEMCPSVCESSHFAVLLGAYGATLSVLDQKILLLLRAYEQNKLSLINFRVLLWGPAAVEHHKTCRSLGRSLWQQPSVGDILRLLDRDRMMQTILHFPQNRRLLPPEDTQELIFKDKSRVDLDGLYDPCFLLQLFSELTRPEFVVDCRKFLDSNALGLTVTALSSYDPQMRAIAYHVLAAYYSHLEGARFQEQSQLLYLLDVVRNGIRTQDMRLTFTLALFIAKAALQILKPEEHMYLKVSNFLLSHEYLNMDKVPGFYQFFYSSDFEQKTEQKWVFGLLRQGIRDKQCYELCARRGIFHIILSFFHSPLCDEAAQNWILEILQNAAQVARSAYEIIRDYSLLTWILHILESKFLETPLLSNVISLLHTLWVTNLGDKAVEWESQRLCQPSSQEPAKRLALHLVNEFLYVLIVLMKHLRPTLAPVQLTNFFGTLDSVLRYRATVIQAFRDMNRFTVNETVLSTKDVLVLLHKWSLIERDLKLQEDLRAAIEKAQARELMKMLKDKNKPVMPARAKGPRGRKRRPGEAEEMADPELMASTLETCKGLLRSILTYWRPVIPGPDPTQEPVDSASPESDAPGPVYAAASLAVSWVLRSVAEHPLSRAEAAGLIGWLKSHILPHPVVVADLLKDSAVRSSIFRLYSRLCGAEGLAGPVQEVACLFNTVMLQLVAAQGRAGSPFHPAMEALSLSSLSEKDEATQASAAFLVSLYIKDIWLGAQRPDTLLTHVRMVCEAADDAPSSEEEAIVVLCKDAASAASDA

SEQ ID NO: 817649 - protein, 2230 aa, Homo sapiens
RARKEELTGVRFKAQLKDPQGPGPGLEAFVSAAKKLPREDVYDVVEGYIKISVECVEIFQLLSGEKRPESETMLIFQVFEAILLRTASDLSHFHVVGTNIVKKLMNNHMKLICESLYASGYRLARACLSLMTAMVTQGPEAARDVCSHFDLNKKTLYTLVTKRDSKGVYDVRQAYVQFALSFLIAGDDSTIVQVLEVKEFIPCIFSSGIKEDRISTINILLSTLKTKVVHNKNITKTQKVRFFTGQLLNHIASLYNWNGITDVNPENVKVSAEEAGKTMVRELVHNFLMDLCCSLKHGINFYDASLGTFGRGGNLTLLHFLLGLKTAADDDLVADLVVNILKVCPDLLNKYFKEVTFSFIPRAKSTWLNNIKLLNKIYEAQPEISRAFQTREFIPLPRLLAMVMVTTVPLVCNKSMFTQALNLDSTSVRHTALSLISVILKRALKTVDHCLNKEVWQESGVYTAVMMEEFVQLFREALSKILPDLNTVVWVWQSLKKQETKQDDKKGQKRSDGPPAACDAHQCDDAETILLKAVLLQVICLYQKVVPHVVMQYNFDFSKLLKGVISEQGLREEVPPILQHHMLKVALELPASKFLWLKAQEGPDAEIIGGERSVFYLLMKMFVTSSHLQLKSLTKLLIMKILRDTGVFEHTWKELELWLEHLENTMEEDKETVIQFLERILLTLVANPYSYTDKASDFVQEASMLQATMTKQEADDMSIPISHIDDVLDMVDVLVEGSEGLDEEIGFTLSEDMILLTFPFSAVVPAALEARNKLLLGTGNEAAENVVTYLTAVLTDLLHTQRDPLALCLLLQAYDKLEPPCLVPCCQQLSRFNRYYSLWIPEQAREAWLLQAQGSPSPPALPLASSFTALLQAAYESQALRDEHIQVQLQATMPHLSMQQVLLAAKQVLLYLRSTVENFGQLGRSVGPPLLQLFLDLLRRLVVHCEQLDAQNQQRCEAARAEADLFLDMESVASLELANDQTLEEVLVAILRHPTLEGWFLALEQQALPPHTLSPVLVKLLATHFSAGVLQLLAASAPILQNIGQLGLLARYSEAITQSVLKELQNRRAGPATSPPKTPPQLEALQELHPYMEGAQLREVTLALLSLPETHLVTQQPTKSPGKERHLNALGKTLVQLLTCSPQDQLQSGELLWSSEYVRGLGALLPTLAVDELDTVLLHTLQRDPVLAPAVGADLLDYCLARRTQAALSIAALLLQESCTHLLWFEQWCLQAGPGLGLQGDLDDFLPLIHVYLQCRTRSHFTRPAGVSSAVIPVLRKTLWRQLQSRLLSTDSPPASGLYQEILAQLVPFARAKDLSVLMDRLPSLLHTPSSHKRWIVADSISAALEGSAEELCAWRRTLLESCVKWLIVSFSGGQQDDDNTQNQEKEMLLRLNALLHALNEVDPGDWQKFVKKGLKFRYQDHTFLKMLLTAVQLLYSPESSVRTKLIQLPVVYVMLMQHSLFLPTLLTSDGEESPDSQVKEALVDLMLTVVEMCPSVCESSHFAVLLGAYGATLSVLDQKILLLLRAYEQNKLSLINFRVLLWGPAAVEHHKTCRSLGRSLWQQPSVGDILRLLDRDRMMQTILHFPQNRRLLPPEDTQELIFKDKSRVDLDGLYDPCFLLQLFSELTRPEFVVDCRKFLDSNALGLTVTALSSYDPQMRAIAYHVLAAYYSHLEGARFQEQSQLLYLLDVVRNGIRTQDMRLTFTLALFIAKAALQILKPEEHMYLKVSNFLLSHEYLNMDKVPGFYQFFYSSDFEQKTEQKWVFGLLRQGIRDKQCYELCARRGIFHIILSFFHSPLCDEAAQNWILEILQNAAQVARSAYEIIRDYSLLTWILHILESKFLETPLLSNVISLLHTLWVTNLGDKAVEWESQRLCQPSSQEPAKRLALHLVNEFLYVLIVLMKHLRPTLAPVQLTNFFGTLDSVLRYRATVIQAFRDMNRFTVNETVLSTKDVLVLLHKWSLIERDLKLQEDLRAAIEKAQARELMRGRKRRPGEAEEMADPELMASTLETCKGLLRSILTYWRPVIPGPDPTQEPVDSASPESDAPGPVYAAASLAVSWVLRSVAEHPLSRAEAAGLIGWLKSHILPHPVVVADLLKDSAVRSSIFRLYSRLCGAEGLAGPVQEVACLFNTVMLQLVAAQGRAGSPFHPAMEALSLSSLSEKDEATQASAAFLVSLYIKDIWLGAQRPDTLLTHVRMVCEAADDAPSSEEEAIVVLCKDAASAASDA

SEQ ID NO: 817650 - protein, 72 aa, Homo sapiens
AQACGTVHLGTWQSRCIVGRMTCFRAEQVCILMAYPLLLFSLRSIPSVSLHKGHLAGGSAAGHPLNPRPDGV

SEQ ID NO: 817651 - protein, 1846 aa, Homo sapiens
RARKEELTGVRFKAQLKDPQGPGPGLEAFVSAAKKLPREDVYDVVEGYIKISVECVEIFQLLSGEKRPESETMLIFQVFEAILLRTASDLSHFHVVGTNIVKKLMNNHMKLICESLYASGYRLARACLSLMTAMVTQGPEAARDVCSHFDLNKKTLYTLVTKRDSKGVYDVRQAYVQFALSFLIAGDDSTIVQVLEVKEFIPCIFSSGIKEDRISTINILLSTLKTKVVHNKNITKTQKVRFFTGQLLNHIASLYNWNGITDVNPENVKVSAEEAGKTMVRELVHNFLMDLCCSLKHGINFYDASLGTFGRGGNLTLLHFLLGLKTAADDDLVADLVVNILKVCPDLLNKYFKEVTFSFIPRAKSTWLNNIKLLNKIYEAQPEISRAFQTREFIPLPRLLAMVMVTTVPLVCNKSMFTQALNLDSTSVRHTALSLISVILKRALKTVDHCLNKEVWQESGVYTAVMMEEFVQLFREALSKILPDLNTVVWVWQSLKKQETKQDDKKGQKRSDGPPAACDAHQCDDAETILLKAVLLQVICLYQKVVPHVVMQYNFDFSKLLKGVISEQGLREEVPPILQHHMLKVALELPASKFLWLKAQEGPDAEIIGGERSVFYLLMKMFVTSSHLQLKSLTKLLIMKILRDTGVFEHTWKELELWLEHLENTMEEDKETVIQFLERILLTLVANPYSYTDKASDFVQEASMLQATMTKQEADDMSIPISHIDDVLDMVDVLVEGSEGLDEEIGFTLSEDMILLTFPFSAVVPAALEARNKLLLGTGNEAAENVVTYLTAVLTDLLHTQRDPLALCLLLQAYDKLEPPCLVPCCQQLSRFNRYYSLWIPEQAREAWLLQAQGSPSPPALPLASSFTALLQAAYESQALRDEHIQVQLQATMPHLSMQQVLLAAKQVLLYLRSTVENFGQLGRSVGPPLLQLFLDLLRRLVVHCEQLDAQNQQRCEAARAEADLFLDMESVASLELANDQTLEEVLVAILRHPTLEGWFLALEQQALPPHTLSPVLVKLLATHFSAGVLQLLAASAPILQNIGQLGLLARYSEAITQSVLKELQNRRAGPATSPPKTPPQLEALQELHPYMEGAQLREVTLALLSLPETHLVTQQPTKSPGKERHLNALGKTLVQLLTCSPQDQLQSGELLWSSEYVRGLGALLPTLAVDELDTVLLHTLQRDPVLAPAVGADLLDYCLARRTQAALSIAALLLQESCTHLLWFEQWCLQAGPGLGLQGDLDDFLPLIHVYLQCRTRSHFTRPAGVSSAVIPVLRKTLWRQLQSRLLSTDSPPASGLYQEILAQLVPFARAKDLSVLMDRLPSLLHTPSSHKRWIVADSISAALEGSAEELCAWRRTLLESCVKWLIVSFSGGQQDDDNTQNQEKEMLLRLNALLHALNEVDPGDWQKFVKKGLKFRYQDHTFLKMLLTAVQLLYSPESSVRTKLIQLPVVYVMLMQHSLFLPTLLTSDGEESPDSQVKEALVDLMLTVVEMCPSVCESSHFAVLLGAYGATLSVLDQKILLLLRAYEQNKLSLINFRVLLWGPAAVEHHKTCRSLGRSLWQQPSVGDILRLLDRDRMMQTILHFPQNRRLLPPEDTQELIFKDKSRVDLDGLYDPCFLLQLFSELTRPEFVVDCRKFLDSNALGLTVTALSSYDPQMRAIAYHVLAAYYSHLEGARFQEQSQLLYLLDVVRNGIRTQDMRLTFTLALFIAKAALQILKPEEHMYLKVSNFLLSHEYLNMDKVPGFYQFFYSSDFEQKTEQKWVFGLLRQGIRDKQCYELCARRGIFHIILSFFHSPLCDEAAQNWILEILQNAAQVARSAYEIIRDYSLLTWILHILESKWRLQ

SEQ ID NO: 817652 - protein, 1780 aa, Homo sapiens
RARKEELTGVRFKAQLKDPQGPGPGLEAFVSAAKKLPREDVYDVVEGYIKISVECVEIFQLLSGEKRPESETMLIFQVFEAILLRTASDLSHFHVVGTNIVKKLMNNHMKLICESLYASGYRLARACLSLMTAMVTQGPEAARDVCSHFDLNKKTLYTLVTKRDSKGVYDVRQAYVQFALSFLIAGDDSTIVQVLEVKEFIPCIFSSGIKEDRISTINILLSTLKTKVVHNKNITKTQKVRFFTGQLLNHIASLYNWNGITDVNPENVKVSAEEAGKTMVRELVHNFLMDLCCSLKHGINFYDASLGTFGRGGNLTLLHFLLGLKTAADDDLVADLVVNILKVCPDLLNKYFKEVTFSFIPRAKSTWLNNIKLLNKIYEAQPEISRAFQTREFIPLPRLLAMVMVTTVPLVCNKSMFTQALNLDSTSVRHTALSLISVILKRALKTVDHCLNKEVWQESGVYTAVMMEEFVQLFREALSKILPDLNTVVWVWQSLKKQETKQDDKKGQKRSDGPPAACDAHQCDDAETILLKAVLLQVICLYQKVVPHVVMQYNFDFSKLLKGVISEQGLREEVPPILQHHMLKVALELPASKFLWLKAQEGPDAEIIGGERSVFYLLMKMFVTSSHLQLKSLTKLLIMKILRDTGVFEHTWKELELWLEHLENTMEEDKETVIQFLERILLTLVANPYSYTDKASDFVQEASMLQATMTKQEADDMSIPISHIDDVLDMVDVLVEGSEGLDEEIGFTLSEDMILLTFPFSAVVPAALEARNKLLLGTGNEAAENVVTYLTAVLTDLLHTQRDPLALCLLLQAYDKLEPPCLVPCCQQLSRFNRYYSLWIPEQAREAWLLQAQGSPSPPALPLASSFTALLQAAYESQALRDEHIQVQLQATMPHLSMQQVLLAAKQVLLYLRSTVENFGQLGRSVGPPLLQLFLDLLRRLVVHCEQLDAQNQQRCEAARAEADLFLDMESVASLELANDQTLEEVLVAILRHPTLEGWFLALEQQALPPHTLSPVLVKLLATHFSAGVLQLLAASAPILQNIGQLGLLARYSEAITQSVLKELQNRRAGPATSPPKTPPQLEALQELHPYMEGAQLREVTLALLSLPETHLVTQQPTKSPGKERHLNALGKTLVQLLTCSPQDQLQSGELLWSSEYVRGLGALLPTLAVDELDTVLLHTLQRDPVLAPAVGADLLDYCLARRTQAALSIAALLLQESCTHLLWFEQWCLQAGPGLGLQGDLDDFLPLIHVYLQCRTRSHFTRPAGVSSAVIPVLRKTLWRQLQSRLLSTDSPPASGLYQEILAQLVPFARAKDLSVLMDRLPSLLHTPSSHKRWIVADSISAALEGSAEELCAWRRTLLESCVKWLIVSFSGGQQDDDNTQNQEKEMLLRLNALLHALNEVDPGDWQKFVKKGLKFRYQDHTFLKMLLTAVQLLYSPESSVRTKLIQLPVVYVMLMQHSLFLPTLLTSDGEESPDSQVKEALVDLMLTVVEMCPSVCESSHFAVLLGAYGATLSVLDQKILLLLRAYEQNKLSLINFRVLLWGPAAVEHHKTCRSLGRSLWQQPSVGDILRLLDRDRMMQTILHFPQNRRLLPPEDTQELIFKDKSRVDLDGLYDPCFLLQLFSELTRPEFVVDCRKFLDSNALGLTVTALSSYDPQMRAIAYHVLAAYYSHLEGARFQEQSQLLYLLDVVRNGIRTQDMRLTFTLALFIAKAALQILKPEEHMYLKVSNFLLSHEYLNMDKVPGFYQFFYSSDFEVCFQSPHGFLQAPELMMQPPLSF

SEQ ID NO: 817653 - protein, 1849 aa, Homo sapiens
RARKEELTGVRFKAQLKDPQGPGPGLEAFVSAAKKLPREDVYDVVEGYIKISVECVEIFQLLSGEKRPESETMLIFQVFEAILLRTASDLSHFHVVGTNIVKKLMNNHMKLICESLYASGYRLARACLSLMTAMVTQGPEAARDVCSHFDLNKKTLYTLVTKRDSKGVYDVRQAYVQFALSFLIAGDDSTIVQVLEVKEFIPCIFSSGIKEDRISTINILLSTLKTKVVHNKNITKTQKVRFFTGQLLNHIASLYNWNGITDVNPENVKVSAEEAGKTMVRELVHNFLMDLCCSLKHGINFYDASLGTFGRGGNLTLLHFLLGLKTAADDDLVADLVVNILKVCPDLLNKYFKEVTFSFIPRAKSTWLNNIKLLNKIYEAQPEISRAFQTREFIPLPRLLAMVMVTTVPLVCNKSMFTQALNLDSTSVRHTALSLISVILKRALKTVDHCLNKEVWQESGVYTAVMMEEFVQLFREALSKILPDLNTVVWVWQSLKKQETKQDDKKGQKRSDGPPAACDAHQCDDAETILLKAVLLQVICLYQKVVPHVVMQYNFDFSKLLKGVISEQGLREEVPPILQHHMLKVALELPASKFLWLKAQEGPDAEIIGGERSVFYLLMKMFVTSSHLQLKSLTKLLIMKILRDTGVFEHTWKELELWLEHLENTMEEDKETVIQFLERILLTLVANPYSYTDKASDFVQEASMLQATMTKQEADDMSIPISHIDDVLDMVDVLVEGSEGLDEEIGFTLSEDMILLTFPFSAVVPAALEARNKLLLGTGNEAAENVVTYLTAVLTDLLHTQRDPLALCLLLQAYDKLEPPCLVPCCQQLSRFNRYYSLWIPEQAREAWLLQAQGSPSPPALPLASSFTALLQAAYESQALRDEHIQVQLQATMPHLSMQQVLLAAKQVLLYLRSTVENFGQLGRSVGPPLLQLFLDLLRRLVVHCEQLDAQNQQRCEAARAEADLFLDMESVASLELANDQTLEEVLVAILRHPTLEGWFLALEQQALPPHTLSPVLVKLLATHFSAGVLQLLAASAPILQNIGQLGLLARYSEAITQSVLKELQNRRAGPATSPPKTPPQLEALQELHPYMEGAQLREVTLALLSLPETHLVTQQPTKSPGKERHLNALGKTLVQLLTCSPQDQLQSGELLWSSEYVRGLGALLPTLAVDELDTVLLHTLQRDPVLAPAVGADLLDYCLARRTQAALSIAALLLQESCTHLLWFEQWCLQAGPGLGLQGDLDDFLPLIHVYLQCRTRSHFTRPAGVSSAVIPVLRKTLWRQLQSRLLSTDSPPASGLYQEILAQLVPFARAKDLSVLMDRLPSLLHTPSSHKRWIVADSISAALEGSAEELCAWRRTLLESCVKWLIVSFSGGQQDDDNTQNQEKEMLLRLNALLHALNEVDPGDWQKFVKKGLKFRYQDHTFLKMLLTAVQLLYSPESSVRTKLIQLPVVYVMLMQHSLFLPTLLTSDGEESPDSQVKEALVDLMLTVVEMCPSVCESSHFAVLLGAYGATLSVLDQKILLLLRAYEQNKLSLINFRVLLWGPAAVEHHKTCRSLGRSLWQQPSVGDILRLLDRDRMMQTILHFPQNRRLLPPEDTQELIFKDKSRVDLDGLYDPCFLLQLFSELTRPEFVVDCRKFLDSNALGLTVTALSSYDPQMRAIAYHVLAAYYSHLEGARFQEQSQLLYLLDVVRNGIRTQDMRLTFTLALFIAKAALQILKPEEHMYLKVSNFLLSHEYLNMDKVPGFYQFFYSSDFEQKTEQKWVFGLLRQGIRDKQCYELCARRGIFHIILSFFHSPLCDEAAQNWILEILQNAAQVARSAYEIIRDYSLLTWILHILESNSGDSAAV

SEQ ID NO: 817654 - protein, 1650 aa, Homo sapiens
RARKEELTGVRFKAQLKDPQGPGPGLEAFVSAAKKLPREDVYDVVEGYIKISVECVEIFQLLSGEKRPESETMLIFQVFEAILLRTASDLSHFHVVGTNIVKKLMNNHMKLICESLYASGYRLARACLSLMTAMVTQGPEAARDVCSHFDLNKKTLYTLVTKRDSKGVYDVRQAYVQFALSFLIAGDDSTIVQVLEVKEFIPCIFSSGIKEDRISTINILLSTLKTKVVHNKNITKTQKVRFFTGQLLNHIASLYNWNGITDVNPENVKVSAEEAGKTMVRELVHNFLMDLCCSLKHGINFYDASLGTFGRGGNLTLLHFLLGLKTAADDDLVADLVVNILKVCPDLLNKYFKEVTFSFIPRAKSTWLNNIKLLNKIYEAQPEISRAFQTREFIPLPRLLAMVMVTTVPLVCNKSMFTQALNLDSTSVRHTALSLISVILKRALKTVDHCLNKEVWQESGVYTAVMMEEFVQLFREALSKILPDLNTVVWVWQSLKKQETKQDDKKGQKRSDGPPAACDAHQCDDAETILLKAVLLQVICLYQKVVPHVVMQYNFDFSKLLKGVISEQGLREEVPPILQHHMLKVALELPASKFLWLKAQEGPDAEIIGGERSVFYLLMKMFVTSSHLQLKSLTKLLIMKILRDTGVFEHTWKELELWLEHLENTMEEDKETVIQFLERILLTLVANPYSYTDKASDFVQEASMLQATMTKQEADDMSIPISHIDDVLDMVDVLVEGSEGLDEEIGFTLSEDMILLTFPFSAVVPAALEARNKLLLGTGNEAAENVVTYLTAVLTDLLHTQRDPLALCLLLQAYDKLEPPCLVPCCQQLSRFNRYYSLWIPEQAREAWLLQAQGSPSPPALPLASSFTALLQAAYESQALRDEHIQVQLQATMPHLSMQQVLLAAKQVLLYLRSTVENFGQLGRSVGPPLLQLFLDLLRRLVVHCEQLDAQNQQRCEAARAEADLFLDMESVASLELANDQTLEEVLVAILRHPTLEGWFLALEQQALPPHTLSPVLVKLLATHFSAGVLQLLAASAPILQNIGQLGLLARYSEAITQSVLKELQNRRAGPATSPPKTPPQLEALQELHPYMEGAQLREVTLALLSLPETHLVTQQPTKSPGKERHLNALGKTLVQLLTCSPQDQLQSGELLWSSEYVRGLGALLPTLAVDELDTVLLHTLQRDPVLAPAVGADLLDYCLARRTQAALSIAALLLQESCTHLLWFEQWCLQAGPGLGLQGDLDDFLPLIHVYLQCRTRSHFTRPAGVSSAVIPVLRKTLWRQLQSRLLSTDSPPASGLYQEILAQLVPFARAKDLSVLMDRLPSLLHTPSSHKRWIVADSISAALEGSAEELCAWRRTLLESCVKWLIVSFSGGQQDDDNTQNQEKEMLLRLNALLHALNEVDPGDWQKFVKKGLKFRYQDHTFLKMLLTAVQLLYSPESSVRTKLIQLPVVYVMLMQHSLFLPTLLTSDGEESPDSQVKEALVDLMLTVVEMCPSVCESSHFAVLLGAYGATLSVLDQKILLLLRAYEQNKLSLINFRVLLWGPAAVEHHKTCRSLGRSLWQQPSVGDILRLLDRDRMMQTILHFPQNRRLLPPEDTQELIFKDKSRVDLDGLYDPCFLLQLFSELTRPGNCSLLLGQGLLCMTSQRSG

SEQ ID NO: 817655 - protein, 1504 aa, Homo sapiens
RARKEELTGVRFKAQLKDPQGPGPGLEAFVSAAKKLPREDVYDVVEGYIKISVECVEIFQLLSGEKRPESETMLIFQVFEAILLRTASDLSHFHVVGTNIVKKLMNNHMKLICESLYASGYRLARACLSLMTAMVTQGPEAARDVCSHFDLNKKTLYTLVTKRDSKGVYDVRQAYVQFALSFLIAGDDSTIVQVLEVKEFIPCIFSSGIKEDRISTINILLSTLKTKVVHNKNITKTQKVRFFTGQLLNHIASLYNWNGITDVNPENVKVSAEEAGKTMVRELVHNFLMDLCCSLKHGINFYDASLGTFGRGGNLTLLHFLLGLKTAADDDLVADLVVNILKVCPDLLNKYFKEVTFSFIPRAKSTWLNNIKLLNKIYEAQPEISRAFQTREFIPLPRLLAMVMVTTVPLVCNKSMFTQALNLDSTSVRHTALSLISVILKRALKTVDHCLNKEVWQESGVYTAVMMEEFVQLFREALSKILPDLNTVVWVWQSLKKQETKQDDKKGQKRSDGPPAACDAHQCDDAETILLKAVLLQVICLYQKVVPHVVMQYNFDFSKLLKGVISEQGLREEVPPILQHHMLKVALELPASKFLWLKAQEGPDAEIIGGERSVFYLLMKMFVTSSHLQLKSLTKLLIMKILRDTGVFEHTWKELELWLEHLENTMEEDKETVIQFLERILLTLVANPYSYTDKASDFVQEASMLQATMTKQEADDMSIPISHIDDVLDMVDVLVEGSEGLDEEIGFTLSEDMILLTFPFSAVVPAALEARNKLLLGTGNEAAENVVTYLTAVLTDLLHTQRDPLALCLLLQAYDKLEPPCLVPCCQQLSRFNRYYSLWIPEQAREAWLLQAQGSPSPPALPLASSFTALLQAAYESQALRDEHIQVQLQATMPHLSMQQVLLAAKQVLLYLRSTVENFGQLGRSVGPPLLQLFLDLLRRLVVHCEQLDAQNQQRCEAARAEADLFLDMESVASLELANDQTLEEVLVAILRHPTLEGWFLALEQQALPPHTLSPVLVKLLATHFSAGVLQLLAASAPILQNIGQLGLLARYSEAITQSVLKELQNRRAGPATSPPKTPPQLEALQELHPYMEGAQLREVTLALLSLPETHLVTQQPTKSPGKERHLNALGKTLVQLLTCSPQDQLQSGELLWSSEYVRGLGALLPTLAVDELDTVLLHTLQRDPVLAPAVGADLLDYCLARRTQAALSIAALLLQESCTHLLWFEQWCLQAGPGLGLQGDLDDFLPLIHVYLQCRTRSHFTRPAGVSSAVIPVLRKTLWRQLQSRLLSTDSPPASGLYQEILAQLVPFARAKDLSVLMDRLPSLLHTPSSHKRWIVADSISAALEGSAEELCAWRRTLLESCVKWLIVSFSGGQQDDDNTQNQEKEMLLRLNALLHALNEVDPGDWQKFVKKGLKFRYQDHTFLKMLLTAVQLLYSPESSVRTKLIQLPVVYVMLMQHSLFLPTLLTSDGEESPDSQVKGDPSPQPFHSVSRFYLLISLHWLH

SEQ ID NO: 817656 - protein, 864 aa, Homo sapiens
RARKEELTGVRFKAQLKDPQGPGPGLEAFVSAAKKLPREDVYDVVEGYIKISVECVEIFQLLSGEKRPESETMLIFQVFEAILLRTASDLSHFHVVGTNIVKKLMNNHMKLICESLYASGYRLARACLSLMTAMVTQGPEAARDVCSHFDLNKKTLYTLVTKRDSKGVYDVRQAYVQFALSFLIAGDDSTIVQVLEVKEFIPCIFSSGIKEDRISTINILLSTLKTKVVHNKNITKTQKVRFFTGQLLNHIASLYNWNGITDVNPENVKVSAEEAGKTMVRELVHNFLMDLCCSLKHGINFYDASLGTFGRGGNLTLLHFLLGLKTAADDDLVADLVVNILKVCPDLLNKYFKEVTFSFIPRAKSTWLNNIKLLNKIYEAQPEISRAFQTREFIPLPRLLAMVMVTTVPLVCNKSMFTQALNLDSTSVRHTALSLISVILKRALKTVDHCLNKEVWQESGVYTAVMMEEFVQLFREALSKILPDLNTVVWVWQSLKKQETKQDDKKGQKRSDGPPAACDAHQCDDAETILLKAVLLQVICLYQKVVPHVVMQYNFDFSKLLKGVISEQGLREEVPPILQHHMLKVALELPASKFLWLKAQEGPDAEIIGGERSVFYLLMKMFVTSSHLQLKSLTKLLIMKILRDTGVFEHTWKELELWLEHLENTMEEDKETVIQFLERILLTLVANPYSYTDKASDFVQEASMLQATMTKQEADDMSIPISHIDDVLDMVDVLVEGSEGLDEEIGFTLSEDMILLTFPFSAVVPAALEARNKLLLGTGNEAAENVVTYLTACHTLREVKKRKLPPMFDCSWGASSTSHSQLLQRELPELTVLSYLSLFFLGWRQNMNRYSFMLSGNHLLFHLL

SEQ ID NO: 817657 - protein, 87 aa, Homo sapiens
TNEAYGRVNIASNYLSGRGAMIESIVVPLELTPWDREAKCYNELNGCTKIYDPVCGTDGNTYPNECVLCFENRKRQTSILIQKSGPC

SEQ ID NO: 817658 - protein, 79 aa, Homo sapiens
MKVTGIFLLSALALLSLSGNTGADSLGREAKCYNELNGCTKIYDPVCGTDGNTYPNECVLCFEGRKRQTSILIQKSGPC

SEQ ID NO: 817659 - protein, 79 aa, Homo sapiens; identical to SEQ ID NO: 817658

SEQ ID NO: 817660 - protein, 79 aa, Homo sapiens; identical to SEQ ID NO: 817658

SEQ ID NO: 817661 - protein, 79 aa, Homo sapiens; identical to SEQ ID NO: 817658

SEQ ID NO: 817662 - protein, 301 aa, Homo sapiens
LQNVGPNPVVQIIYSDKFRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 817663 - protein, 301 aa, Homo sapiens; identical to SEQ ID NO: 817662

SEQ ID NO: 817664 - protein, 301 aa, Homo sapiens; identical to SEQ ID NO: 817662

SEQ ID NO: 817665 - protein, 301 aa, Homo sapiens; identical to SEQ ID NO: 817662

SEQ ID NO: 817666 - protein, 124 aa, Homo sapiens
GLFSLDLSTALFFLHKIKSLFFVVVYRILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 817667 - protein, 92 aa, Homo sapiens
VGGGGRLGTSSAPRPLRPLPSLSLALFSHTPGRRLGFVRGDGVAPWPPKEEPDTCLPSPSCSPPLEERPPPRLGAFCVSRLVGKPLRRRHHE

SEQ ID NO: 817668 - protein, 148 aa, Homo sapiens
VGGGGRLGTSSAPRPLRPLPSLSLALFSHTPGRRLGFVRGDGVAPWPPKEEPDTCLPSPSCSPPLEERPPPRLGAFCVSRLVGKPLRRRHHEVRGARGGGRAGHCAAGAATPVLLGPRLPSPGPARLPWSPVCSSPLRLLSLPISLSF

SEQ ID NO: 817669 - protein, 126 aa, Homo sapiens
PPPPPPPPLPNQVPPPPPPPPAPPLPASGFFLASMSEDNRPLTGLAAAIAGAKLRKVSRMEDTSFPSGGNAIGVNSASSKTDTGRGNGPLPLGGSGLMEEMSALLARRRRNFLEKGFTIGNKRGPR

SEQ ID NO: 817670 - protein, 102 aa, Homo sapiens
VGGGGRLGTSSAPRPLRPLPSLSLALFSHTPGRRLGFVRGDGVAPWPPKEEPDTCLPSPSCSPPLEERPPPRLGAFCVSRLVGKPLRRRHHETESDCCPGWS

SEQ ID NO: 817671 - protein, 223 aa, Homo sapiens
PPPPPPPPLPNQVPPPPPPPPAPPLPASGFFLASMSEDNRPLTGLAAAIAGAKLRKVSRMEDTSFPSGGNAIGVNSASSKTDTGRGNGPLPLGGSGLMEEMSALLARRRRIAEKGSTIETEQKEDKGEDSEPVTSKASSTSTPEPTRKPWERTNTMNGSKSPVISRPKSTPLSQPSANGVQTEGLDYDRLKQDILDEMRKELTKLKEELIDAIRQELSKSNTA

SEQ ID NO: 817672 - protein, 223 aa, Homo sapiens; identical to SEQ ID NO: 817671

SEQ ID NO: 817673 - protein, 223 aa, Homo sapiens; identical to SEQ ID NO: 817671

SEQ ID NO: 817674 - protein, 223 aa, Homo sapiens; identical to SEQ ID NO: 817671

SEQ ID NO: 817675 - protein, 223 aa, Homo sapiens; identical to SEQ ID NO: 817671

SEQ ID NO: 817676 - protein, 1029 aa, Homo sapiens
MNFKYSKICIVFIHDADFLKPTYKQSVLFLYYKVLILSSILNSDVFIRNTKIQSLYFFFDQTQIFPFPPPFSSPLLVDRVFPIFINICSHYRVTVVKFSAVFFFFFLLYPVSCSCFSSYVSQYFCLQIKSHLSFKNELSNMMNLLNLPSYNFYVSCKFIYTFSAIVKNWPFNSKYVLPYEDTVCKGMLQGLFNSCVAIIILYHHYPLNSTDYKQRKSNYIKQTSQRNSAGALNSLCSYHKIHFPEDIYSHSLPNSKPFSGSTTFVFNRKMSSICTSLQSSKEGEKDPSILKLLMFEYLCLFTKSHLIFLKSKLDIQVFIRNLHDSEENEIDVGSFGYVKDIVEDNYLKKSFLLRIVDLTKQLKSVTPQERPFIEAKNCWRSVMQVFLFPTSKAVDYLVCSPLCYLSIIFETSRFFKISYWKDETFKLKPKIDLKEKYNINAVNLGWLQILTININKWSSRINYLWNTNGQVTVRVKSFGEETHLTTAKELTKFVFLNSFLYKVTETCKRIINDCHNDLGCCKNVCHIYWLFLLKSEGIDTSENLEREIGLSPLQILCDGTQPSKRKCKYHLKHIVGLEYLQINMQKKSKMKPQLSVRTKESQSLSCTPVLCSMLNTHKEQRAGPVDASGVGHRNSRQREKIRGPSWWLRVKRIYHLSSAVLFPQFLKTYEFLVVRTSKYSVNWSEAGGLLEARSFEISLGNIARPVSLKNKEINNKVNKSNKNLVLDYCAVLLPLCRDGVGVRISMCMNGGKLWWCLLFVCFLRGGGVSSEPFWLKNNVHNFYYEIKKVKYFFFSGLTKLIDQKYIVEQHSRKNLKVNFLWSKRMDESQSITFHNICWNWNLLSSCFALNFRTRSVQYVKRLCRAIFFANNVNICTPGMGLYNLEVSLRLRILKSCFKSKVDFKHIQGCILIVTRNHLLCIQNLMYLIMEFVNYGPLPNFKGKGNWYQLVLNQHTISSCLLDSSCLKIRIKQDLIVRKHLLSLTSTFEEGNVEEKVRHETKTAGRVGSELHLIFGPKFHIGINKKEDHL

SEQ ID NO: 817677 - protein, 794 aa, Homo sapiens
MHKIHFPEDIYSHSLPNSKPFSGSTTFVFNREDEFISVHLSKALRNEKRILSILKLLMFEYLCLFTKSHLIFLKSKLDIQVFIRNLHDSEENEIDVGSFGYVKDIVEDNYLKKSFLLRIVDLTKQLKSVTPQERPFIEAKNCWRSVMQVFLFPTSKAVDYLVCSPLCYLSIIFETSRFFKISYWKDETFKLKPKIDVERKVKINAVNLGWLQILTININKWSSRINYLWNTNGQVTVRVKSFGEETHLTTAKELTKFVFLNSFLYKVTEDIVKGYINDCHNDLGCCKNVCHIYWLFLLKSEGIDTSENLEREIGLSPLQILCDGTQPSKRKCKYHLKHIVGLEYLQINMQKKSKMKPQLSVRTKESQSLSCTPVLCSMLNTHKEQRAGPVDASGVGHRNSRQREKIRGPSWWLRVKRIYHLSSAVLFPQFLKTYEFLVVRTSKYSVNWSEAGGLLEARSFEISLGNIARPVSLKNKEINNKVNKSNKNLVLDYCAVLLPLCRDGVGVRISMCMNGGKLWWCLLFVCFLRGGGVSSEPFWLKNNVHNFYYEIKKVKYFFFSGLTKLIDQKYIVEQHSRKNLKVNFLWSKRMDESQSITFHNICWNWNLLSSCFALNFRTRSVQYVKRLCRAIFFANNVNICTPGMGLYNLEVSLRLRILKSCFKSKVDFKHIQGCILIVTRNHLLCIQNLMYLIMEFVNYGPLPNFKGKGNWYQLVLNQHTISSCLLDSSCLKIRIKQDLIVRKHLLSLTSTFEEGNVEEKVRHETKTAGRVGSELHLIFGPKFHIGINKKEDHL

SEQ ID NO: 817678 - protein, 943 aa, Homo sapiens
MQPLQSYSCKIFSCFFFFFFALACLMFLLLFICTVSIFVYKLKVTCHSKMMLSNMMNLLNLPSYNFYVSCKFIYTFSAIVKNWPFNSKYVLPYEDTVCKGMLQGLFNSCVAIIILEHHYPLNSTDYKQRKSNYIKQTSQRNSAGLLIPLCSYHKIHFPEDIYSHSLPNSKPFSGSTTFVFNRKMSSICTSLQSSKEGEKDPSILKLLMFEYLCLFTKSHLIFLKSKLDIQVFIRNLHDSEENEIDVGSFGYVKDIVEDNYLKKSFLLRIVDLTKQLKSVTPQERPFIEAKNCWRSVMQVFLFPTSKAVDYLVCSPLCYLSIIFETSRFFKISYWKDETFKLKPKIDLKEKYNINAVNLGWLQILTININKWSSRINYLWNTNGQVTVRVKSFGEETHLTTAKELTKFVFLNSFLYKVTETCKRIINDCHNDLGCCKNVCHIYWLFLLKSEGIDTSENGEREIGLSPLQILCDGTQPSKRKCKYHLKHIVGLEYLQINMQKKSKMKPQLSVRTKESQSLSCTPVLCSMLNTHKEQRAGPVDASGVGHRNSRQREKIRGPSWWLRVKRIYHLSSAVLFPQFLKTYEFLVVRTSKYSVNWSEAGGLLEARSFEISLGNIARPVSLKNKEINNKSNKLNKNLVLDYCAVLLPLCRDGVGVRISMCMNGGKLWWCLLFVCFLRGGGVSSEPFWLKNNVHNFYYEIKKVKYFFFSGLTKLIDQKYIVEQHSRKNLKVNFLWSKRMDESQSITFHNICWNWNLLSSCFALNFRTRSVQYVKRLCRAIFFANNVNICTPGMGLYNLEVSLRLRILKSCFKSKVDFKHIQGCILIVTRNHLLCIQNLMYLIMEFVNYWALAEFKGKGNWYQLVLNQHTISSCLLDSSCLKIRIKQDLIVRKHLLSLTSTFEEGNVEEKVRHETKTAGRVGSELHLIFGPKFHIGINKKEDHL

SEQ ID NO: 817679 - protein, 792 aa, Homo sapiens
MHKIHFPEDIYSHSLPNSKPFSGSTTFVFNRKMSSICTSLQSSKEGEKDPSILKLLMFEYLCLFTKSHLIFLKSKLDIQVFIRNLHDSEENEIDVGSFGYVKDIVEDNYLKKSFLLRIVDLTKQLKSVTPQERPFIEAKNCWRSVMQVFLFPTSKAVDYLVCSPLCYLSIIFETSRFFKISYWKDETFKLKPKIDLKEKKNINAVNLGWLQILTININKWSSRINYLWNTNGQVTVRVKSFGEETHLTTAKELTKFVFLNSFLYKVTETCKRIINDCHNDLGCCKNVCHIYWLFLLKSEGIDTSENGEREIGLSPLQILCDGTQPSKRKCKYHLKHIVGLEYLQINMQKKSKMKPQLSVRTKESQSLSCTPVLCSMLNTHKEQRAGPVDASGVGHRNSRQREKIRGPSWWLRVKRIYHLSSAVLFPQFLKTYEFLVVRTSKYSVNWSEAGGLLEARSFEISLGNIARPVSLKNKEINNKSNKLNKNLVLDYCAVLLPLCRDGVGVRISMCMNGGKLWWCLLFVCFLRGGGVSSEPFWLKNNVHNFYYEIKKVKYFFFSGLTKLIDQKYIVEQHSRKNLKVNFLWSKRMDESQSITFHNICWNWNLLSSCFALNFRTRSVQYVKRLCRAIFFANNVNICTPGMGLYNLEVSLRLRILKSCFKSKVDFKHIQGCILIVTRNHLLCIQNLMYLIMEFVNYWALAEFKGKGNWYQLVLNQHTISSCLLDSSCLKIRIKQDLIVRKHLLSLTSTFEEGNVEEKVRHETKTAGRVGSELHLIFGPKFHIGINKKEDHL

SEQ ID NO: 817680 - protein, 1028 aa, Homo sapiens
MNFKYSKICIVFIHDADFLKPTYEAVVLFLYYKVLILSSILNSDVFIRNTKIQSLYFFFDQTQIFPFPPPFSSPLLVDRVFPIFINICSHYRVTVVKFSAVFFFFFLLYPVSCSCFSSYVSQYFCLQIKSHLSFKNELSNMMNLLNLPSYNFYVSCKFIYTFSAIVKNWPFNSKKYYPMKHSVKGMLQGLFNSCVAIIILEHHYPLNSTDYKQRKSNYIKQTSQRNSAGLLIPLCSYHKIHFPEDIYSHSLPNSKPFSGSTTFVFNRKMSSICTSLQSSKEGEKDPSILKLLMFEYLCLFTKSHLIFLKSKLDIQVFIRNLHDSEENEIDVGSFGYVKDIVEDNYLKKSFLLRIVDLTKQLKSVTPQERPFIEAKNCWRSVMQVFLFPTSKAVDYLVCSPLCYLSIIFETSRFFKISYWKDETFKLKPKIDLKEKENINAVNLGWLQILTININKWSSRINYLWNTNGQVTVRVKSFGEETHLTTAKELTKFVFLNSFLYKVTETCKRIINDCHNDLGCCKNVCHIYWLFLLKSEGIDTSENGEREIGLSPLQILCDGTQPSKRKCKYHLKHIVGLEYLQINMQKKSKMKPQLSVRTKESQSLSCTPVLCSMLNTHKEQRAGPVDASGVGHRNSRQREKIRGPSWWLRVKRIYHLSSAVLFPQFLKTYEFLVVRTSKYSVNWSEAGGLLEARSFEISLGNIARPVSLKNKLINNKSNKVNKNLVLDYCAVLLPLCRDGVGVRISMCMNGGKLWWCLFVVCFLRGGGVSSEPFWLKNNVHNFYYEILKVKYFFFSGLTKLIDQKYIVEQHSRKNLKVNFLWSKRMDKSQSITFHNICWNWNLLSSCFALNFRTRSVQYVKRLCRAIFFANNVNICTPGMGLYNLEVSLRLRILKSCFKSKVDFKHIQGCILIVTRNHLLCIQNLMYLIMEFVNYGPLPNFKGKGNWYQLVLNQHTISSCLLDSSCLKIRIKQDLIVRKHLLSLTSTFEEGNVEEKVRHETKTAGRVGSELHLIFGPKFHIGINKKEDHL

SEQ ID NO: 817681 - protein, 223 aa, Homo sapiens; identical to SEQ ID NO: 817671

SEQ ID NO: 817682 - protein, 285 aa, Homo sapiens
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLDRERQERQERERLERLERERQERERQEQLEREQLEWERERRISSAGKKFTNSSVFLYLSLDDVSCAVMC

SEQ ID NO: 817683 - protein, 338 aa, Homo sapiens
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLERQERLDRERQERQERERLERLERERQERERQEQLEREQLEWERERRISSAAAPASVETPLNSVLGDSSASEPGLQAASQPAETPSQQGIVLGPLAPPPPPPLPPGPAQASVALPPPPGPLH

SEQ ID NO: 817684 - protein, 234 aa, Homo sapiens
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLERQERLDRERQERQERER

SEQ ID NO: 817685 - protein, 294 aa, Homo sapiens
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLERQERLDRERQERQERERLERLERERQERERQEQLEREQLEWERERRISSAVNRVSVRQELLVMVYDDANKKWVPAGG

SEQ ID NO: 817686 - protein, 466 aa, Homo sapiens
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLERQERLDRERQERQERERLERLERERQERERQEQLEREQLEWERERRISSAAPSSDSSLYNAPLPEYSSCQPPSAPPPSYAKVISAPVSDATPDYAVVTALPPTSTPPTPPLRHSATRFATSLGSAFHPVLPHYATVPRPLNKNSRPSSPVNTPSSQPPATKPCAWSTSNFSPLPPSPPIMISSPPGKATGPRPVLPVCVSSPVPQMPPSPTAPNGLVDSVTYPVSPPPTSGPAAPPPPPPLPSLASLSH

SEQ ID NO: 817687 - protein, 460 aa, Homo sapiens
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLDRERQERQERERLERLERERQERERQEQLEREQLEWERERRISSAAPSSDSSLYNAPLPEYSSCQPPSAPPPSYAKVISAPVSDATPDYAVVTALPPTSTPPTPPLRHSATRFATSLGSAFHPVLPHYATVPRPLNKNSRPSSPVNTPSSQPPATKPCAWSTSNFSPLPPSPPIMISSPPGKATGPRPVLPVCVSSPVPQMPPSPTAPNGLVDSVTYPVSPPPTSGPAAPPPPPPLPSLASLSH

SEQ ID NO: 817688 - protein, 428 aa, Homo sapiens
MITGVFSMRLWTPVGVLTSLAYCLHQRRVALAELQEADGQCPVDRSLLKLKMVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQAHNLPSCPMLKRFARMIEQRAVDTSLYILPKEDRESLQMAVGPFLHILESNLLKAMDSATAPDKIRKLYLYAAHDVTFIPLLMTLGIFDHKWPPFAVDLTMELYQHLESKEWFVQLYYHGKEQVPRGCPDGLCPLDMFLNAMSVYTLSPEKYHALCSQTQVMEVGNEE

SEQ ID NO: 817689 - protein, 141 aa, Homo sapiens [sequence omitted]

SEQ ID NO: 817690 - protein, 119 aa, Homo sapiens
MITGVFSMRLWTPVGVLTSLAYCLHQRRVALAELQEADGQCPVDRSLLKLKMVQVVFRHGARSPLKPLPLEEQVRGRPGLGWWGEDRVPGQESRPDTHLQSFTRAERGSGWVQKKGKQQ

SEQ ID NO: 817691 - protein, 111 aa, Homo sapiens
MITGVFSMRLWTPVGVLTSLAYCLHQRRVALAELQEADGQCPVDRSLLKLKMVQVVFRHGARSPLKPLPLEEQVQVEPQYKGPNQIQVDYSYNLAGIQTFSYISNHNTVGQ

SEQ ID NO: 817692 - protein, 428 aa, Homo sapiens; identical to SEQ ID NO: 817688

SEQ ID NO: 817693 - protein, 377 aa, Homo sapiens
MVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQAHNLPSCPMLKRFARMIEQRAVDTSLYILPKEDRESLQMAVGPFLHILESNLLKAMDSATAPDKIRKLYLYAAHDVTFIPLLMTLGIFDHKWPPFAVDLTMELYQHLESKEWFVQLYYHGKEQVPRGCPDGLCPLDMFLNAMSVYTLSPEKYHALCSQTQVMEVGNEE

SEQ ID NO: 817694 - protein, 160 aa, Homo sapiens [sequence omitted]

SEQ ID NO: 817695 - protein, 148 aa, Homo sapiens
MITGVFSMRLWTPVGVLTSLAYCLHQRRVALAELQEADGQCPVDRSLLKLKMVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDMA

SEQ ID NO: 817696 - protein, 643 aa, Homo sapiens
PLPLSGRPAPPHPLPRGSRGLAPYPHLKTTMATIPDWKLQLLARRRQEEASVRGREKAERERLSQMPAWKRGLLERRRAKLGLSPGEPSPVLGTVEAGPPDPDESAVLLEAIGPVHQNRFIRQERQQQQQQQQRSEELLAERKPGPLEARERRPSPGEMRDQSPKGRESREERLSPRETRERRLGIGGAQELSLRPLEARDWRQSPGEVGDRSSRLSEAWKWRLSPGETPERSLRLAESREQSPRRKEVESRLSPGESAYQKLGLTEAHKWRPDSRESQEQSLVQLEATEWRLRSGEERQDYSEECGRKEEWPVPGVAPKETAELSETLTREAQGNSSAGVEAAEQRPVEDGERGMKPTEGWKWTLNSGKAREWTPRDIEAQTQKPEPPESAEKLLESPGVEAGEGEAEKEEAGAQGRPLRALQNCCSVPSPLPPEDAGTGGLRQQEEEAVELQPPPPAPLSPPPPAPTAPQPPGDPLMSRLFYGVKAGPGVGAPRRSGHTFTVNPRRSVPPATPATPTSPATVDAAVPGAGKKRYPTAEEILVLGGYLRLSRSCLAKGSPERHHKQLKISFSETALETTYQYPSESSVLEELGPEPEVPSAPNPPAAQPDDEEDEEELLLLQPELQGGLRTKALIVDESCRR

SEQ ID NO: 817697 - protein, 274 aa, Homo sapiens
PLPLSGRPAPPHPLPRGSRGLAPYPHLKTTMATIPDWKLQLLARRRQEEASVRGREKAERERLSQMPAWKRGLLERRRAKLGLSPGEPSPVLGTVEAGPPDPDESAVLLEAIGPVHQNRFIRQERQQQQQQQQRSEELLAERKPGPLEARERRPSPPQPLQPQLMLQSRGLGRSGTQLPRRSWFWGATSVSAAAALPRGPPKDTTNSLRSPSARQPWRPRTNTPPRVRYWRSWARSLRSPVPPTLQQPNPTTKRMRKSCCCCSQSSRAGCAPRP

SEQ ID NO: 817698 - protein, 613 aa, Homo sapiens
MATIPDWKLQLLARRRQEEASVRGREKAERERLSQMPAWKRGLLERRRAKLGLSPGEPSPVLGTVEAGPPDPDESAVLLEAIGPVHQNRFIRQERQQQQQQQQRSEELLAERKPGPLEARERRPSPGEMRDQSPKGRESREERLSPRETRERRLGIGGAQELSLRPLEARDWRQSPGEVGDRSSRLSEAWKWRLSPGETPERSLRLAESREQSPRRKEVESRLSPGESAYQKLGLTEAHKWRPDSRESQEQSLVQLEATEWRLRSGEERQDYSEECGRKEEWPVPGVAPKETAELSETLTREAQGNSSAGVEAAEQRPVEDGERGMKPTEGWKWTLNSGKAREWTPRDIEAQTQKPEPPESAEKLLESPGVEAGEGEAEKEEAGAQGRPLRALQNCCSVPSPLPPEDAGTGGLRQQEEEAVELQPPPPAPLSPPPPAPTAPQPPGDPLMSRLFYGVKAGPGVGAPRRSGHTFTVNPRRSVPPATPATPTSPATVDAAVPGAGKKRYPTAEEILVLGGYLRLSRSCLAKGSPERHHKQLKISFSETALETTYQYPSESSVLEELGPEPEVPSAPNPPAAQPDDEEDEEELLLLQPELQGGLRTKALIVDESCRR

SEQ ID NO: 817699 - protein, 400 aa, Homo sapiens
MATIPDWKLQLLARRRQEEASVRGREKAERERLSQMPAWKRGLLERRRAKLGLSPGEPSPVLGTVEAGPPDPDESAVLLEAIGPVHQNRFIRQERQQQQQQQQRSEELLAERKPGPLEARERRPSPGEMRDQSPKGRESREERLSPRETRERRLGIGGAQELSLRPLEARDWRQSPGEVGDRSSRLSEAWKWRLSPGETPERSLRLAESREQSPRRKEVESRLSPGESAYQKLGLTEAHKWRPDSRESQEQSLVQLEATEWRLRSGEERQDYSEECGRKEEWPVPGVAPKETAELSETLTREAQGNSSAGVEAAEQRPVEDGERGMKPTEGWKWTLPPPLTTAWFTNSISSQPHLPKSQVYKPRLLAVSAWNSLLCPLQSPHWSDLKVWLPPLFLSITLP

SEQ ID NO: 817700 - protein, 613 aa, Homo sapiens; identical to SEQ ID NO: 817698

SEQ ID NO: 817701 - protein, 613 aa, Homo sapiens; identical to SEQ ID NO: 817698

SEQ ID NO: 817702 - protein, 613 aa, Homo sapiens; identical to SEQ ID NO: 817698

SEQ ID NO: 817703 - protein, 507 aa, Homo sapiens
MYCAYTIPGMGGNSLMYYYNGKAVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 817704 - protein, 660 aa, Homo sapiens
RQILYEMEMDIATFMAKMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 817705 - protein, 702 aa, Homo sapiens
GGSWLCVCGSVVAAAAAAAGRQQARERAQEQAAAVAAAVRHERRLGAGGARRAPSRARAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 817706 - protein, 638 aa, Homo sapiens
MLKMFFRISQVAGSSWYSKDVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 817707 - protein, 537 aa, Homo sapiens
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 817708 - protein, 537 aa, Homo sapiens; identical to SEQ ID NO: 817707

SEQ ID NO: 817709 - protein, 537 aa, Homo sapiens; identical to SEQ ID NO: 817707

SEQ ID NO: 817710 - protein, 667 aa, Homo sapiens
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 817711 - protein, 667 aa, Homo sapiens; identical to SEQ ID NO: 817710

SEQ ID NO: 817712 - protein, 643 aa, Homo sapiens
MFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 817713 - protein, 625 aa, Homo sapiens
MEEDSRDVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 817714 - protein, 196 aa, Homo sapiens
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSINGMCWKGQQIRS

SEQ ID NO: 817715 - protein, 537 aa, Homo sapiens; identical to SEQ ID NO: 817707

SEQ ID NO: 817716 - protein, 115 aa, Homo sapiens
LSVRKGLFGKAKGSCQFKEMPPILRCPMALPCPPPLPDHGNKISFLVISSLGQREFQTRLLARLGPTLSGFTQEPWLKWTKGLPSTEEATRVIRVLDDGQAIAHTCLSSSSIWCS

SEQ ID NO: 817717 - protein, 115 aa, Homo sapiens; identical to SEQ ID NO: 817716

SEQ ID NO: 817718 - protein, 115 aa, Homo sapiens; identical to SEQ ID NO: 817716

SEQ ID NO: 817719 - protein, 115 aa, Homo sapiens; identical to SEQ ID NO: 817716

SEQ ID NO: 817720 - protein, 495 aa, Homo sapiens
MRLTRCQAALAAAITLNLLVLFYVSWLQHQPRNSRARGPRRASAAGPRVTVLVREFEAFDNAVPELVDSFLQQDPAQPVVVAADTLPYPPLALPRIPNVRLALLQPALDRPAAASRPETYVATEFVALVPDGARAEAPGLLERMVEALRAGSARLVAAPVATANPARCLALNVSLREWTARYGAAPAAPRCDALDGDAVVLLRARDLFNLSAPLARPVGTSLFLQTALRGWAVQLLDLTFAAARQPPLATAHARWKAEREGRARRAALLRALGIRLVSWEGGRLEWFGCNKETTRCFGTVVGDTPAYLYEERWTPPCCLRALRETARYVVGVLEAAGVRYWLEGGSLLGAARHGDIIPWDYDVDLGIYLEDVGNCEQLRGAEAGSVVDERGFVWEKAVEGDFFRVQYSESNHLHVDLWPFYPRNGVMTKDTWLDHRQDVEFPEHFLQPLVPLPFAGFVAQAPNNYRRFLELKFGPGVIENPQYPNPALLSLTGSG

SEQ ID NO: 817721 - protein, 495 aa, Homo sapiens; identical to SEQ ID NO: 817720

SEQ ID NO: 817722 - protein, 495 aa, Homo sapiens; identical to SEQ ID NO: 817720

SEQ ID NO: 817723 - protein, 495 aa, Homo sapiens; identical to SEQ ID NO: 817720

SEQ ID NO: 817724 - protein, 495 aa, Homo sapiens; identical to SEQ ID NO: 817720

SEQ ID NO: 817725 - protein, 495 aa, Homo sapiens; identical to SEQ ID NO: 817720

SEQ ID NO: 817726 - protein, 292 aa, Homo sapiens
QKVVELCYHAAHLTELSNHMFHGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGGDIRAFNR

SEQ ID NO: 817727 - protein, 286 aa, Homo sapiens
RHRAHASPRGMPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGGDIRAFNR

SEQ ID NO: 817728 - protein, 286 aa, Homo sapiens; identical to SEQ ID NO: 817727

SEQ ID NO: 817729 - protein, 286 aa, Homo sapiens; identical to SEQ ID NO: 817727

SEQ ID NO: 817730 - protein, 135 aa, Homo sapiens
RHRAHASPRGMPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIAGFAELLSLGSGRL

SEQ ID NO: 817731 - protein, 257 aa, Homo sapiens
QKVVELCYHAAHLTELSNHMFHGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGGDIRAFNR

SEQ ID NO: 817732 - protein, 101 aa, Homo sapiens
QKVVELCYHAAHLTELSNHMFHGGSGGDGSNSGSYSGDASGAVTVWEVVSLLGKLLGTVVALKVVLYLLRVCLAMAWKSGGASHSELIHNLRTCICARTSI

SEQ ID NO: 817733 - protein, 268 aa, Homo sapiens
RHRAHASPRGMPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQLHEGAKALDVGSGSGILTACFARMDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGGDIRAFNR

SEQ ID NO: 817734 - protein, 281 aa, Homo sapiens
RHRAHASPRGMPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQLHEGAKALDVGSGSGILTACFARMVGCTGKVIGIDHIKELVDVRKDDPTLLSSGRVQLVVGDGRMGYAEEAPYDAIHVGAAAPVVPQALIDQLKPGGRLILPVGPAGGNQMLEQYDKLQDGSIKMKPLMGGDIRAFNR

SEQ ID NO: 817735 - protein, 257 aa, Homo sapiens; identical to SEQ ID NO: 817731

SEQ ID NO: 817736 - protein, 173 aa, Homo sapiens
HEGAKALDATDQIEVLAHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGGDIRAFNR

SEQ ID NO: 817737 - protein, 215 aa, Homo sapiens
RHRAHASPRGMPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQLHEGAKALDVGSGSGILTACFARMVGCTGKVIGIDHIKELVDDSVNNVRKDDPTLLSSGRVQLVGGMQDGIC

SEQ ID NO: 817738 - protein, 286 aa, Homo sapiens; identical to SEQ ID NO: 817727

SEQ ID NO: 817739 - protein, 286 aa, Homo sapiens; identical to SEQ ID NO: 817727

SEQ ID NO: 817740 - protein, 286 aa, Homo sapiens; identical to SEQ ID NO: 817727

SEQ ID NO: 817741 - protein, 257 aa, Homo sapiens
QKVVELCYHAAHLTELSNHMFHGGSGGDGSNSGSYSGDASGAVTVWEVVSLLGKLLGTVVALKVVLYLLRVCLAMAWKSGGASHSELIHNLRSFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGGDIRAFNR

SEQ ID NO: 817742 - protein, 121 aa, Homo sapiens
IAFYGDHLNPGIAVSRLLHSASDMSVRKDDPTLLSSGRVQLVVGDGRMGYAEEAPYDAIHVGAAAPVVPQALIDQLKPGGRLILPVGPAGGNQMLEQYDKLQDGSIKMKPLMGGDIRAFNR

SEQ ID NO: 817743 - protein, 573 aa, Homo sapiens
RHRAHASPRGMPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGQPSTHMHSLMHAGLHHHVHFHTSITSTHSQMVPGHAHVSTSKHHSIEPSYSTLPAGICLHSSGSLKDLFCKKPNDPFNRPLQLGHFASQLRYFSSHANHAVATQNREIFIDIRFNTQGPQTAQRCVNRQRECHTIIHLRSFTSPLLKQLPPRNNAPLAKNNTDATKAAGTRTRPPTRGNDPYERRDTQQAVNAQRTRENNRRHTKKGAPATREPERNNTNANQTPGARQTSSPTTPSQRRPTMRHHRGRTQRHPSNAPPHTSDGDQQLAQTQPPRHQLSTHPGSTTPTADHTGQHRQQDRAKTT

SEQ ID NO: 817744 - protein, 2411 aa, Homo sapiens
NSESGESQRGQALGSGASTAPLIPRQGLGGNEPGEPGPEPTEPGAAEPPAPRPPPPPPPPPPPPARSLSRRGGGERSERSAAAEPREARPGGWGGQPGGLGPGAGWEGEEKTKTGPGLSADETAGIMAAQVAPAAASSLGNPPPPPPSELKKAEQQQREEAGVEAAAAAAAERGEMKAAAGQESEGPAVGPPHPLGKELLDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 817745 - protein, 1717 aa, Homo sapiens
NSESGESQRGQALGSGASTAPLIPRQGLGGNEPGEPGPEPTEPGAAEPPAPRPPPPPPPPPPPPARSLSRRGGGERSERSAAAEPREARPGGWGGQPGGLGPGAGWEGEEKTKTGPGLSADETAGIMAAQVAPAAASSLGNPPPPPPSELKKAEQQQREEAGVEAAAAAAAERGEMKAAAGQESEGPAVGPPHPLGKELLDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPKHMYYNVCIHSGTIS

SEQ ID NO: 817746 - protein, 508 aa, Homo sapiens
NSESGESQRGQALGSGASTAPLIPRQGLGGNEPGEPGPEPTEPGAAEPPAPRPPPPPPPPPPPPARSLSRRGGGERSERSAAAEPREARPGGWGGQPGGLGPGGGVGGGEKTKTGPGLSADETAGIMAAQVAPAAASSLGNPPPPPPSELKKAEQQQREEAGVEAAAAAAAERGEMKAAAGQESEGPAVGPPHPLGKELLDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQVHS

SEQ ID NO: 817747 - protein, 108 aa, Homo sapiens
MIHLWWTAQISLGVCRSLTVACCTGGLVGGTPLSISRPTSRARQQTGFQEPVFDEARTEEQASKRASPRQAWPHLRPCLGWGMWPGVLLCSPSLGAFFWKNKIASLLK

SEQ ID NO: 817748 - protein, 2411 aa, Homo sapiens; identical to SEQ ID NO: 817744

SEQ ID NO: 817749 - protein, 1902 aa, Homo sapiens
MDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 817750 - protein, 2411 aa, Homo sapiens; identical to SEQ ID NO: 817744

SEQ ID NO: 817751 - protein, 2411 aa, Homo sapiens; identical to SEQ ID NO: 817744

SEQ ID NO: 817752 - protein, 1726 aa, Homo sapiens
SVLVGLEDDRVICVERVVSLVIFELAEEGGGVNQPQQSMLTHLKMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 817753 - protein, 1500 aa, Homo sapiens
NSESGESQRGQALGSGASTAPLIPRQGLGGNEPGEPGPEPTEPGAAEPPAPRPPPPPPPPPPPPARSLSRRGGGERSERSAAAEPREARPGGWGGQPGGLGPGGGVGGGEKTKTGPGLSADETAGIMAAQVAPAAASSLGNPPPPPPSELKKAEQQQREEAGVEAAAAAAAERGEMKAAAGQESEGPAVGPPHPLGKELLDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQEPRRHGG

SEQ ID NO: 817754 - protein, 2411 aa, Homo sapiens; identical to SEQ ID NO: 817744

SEQ ID NO: 817755 - protein, 1530 aa, Homo sapiens
NSESGESQRGQALGSGASTAPLIPRQGLGGNEPGEPGPEPTEPGAAEPPAPRPPPPPPPPPPPPARSLSRRGGGERSERSAAAEPREARPGGWGGQPGGLGPGGGVGGGEKTKTGPGLSADETAGIMAAQVAPAAASSLGNPPPPPPSELKKAEQQQREEAGVEAAAAAAAERGEMKAAAGQESEGPAVGPPHPLGKELLDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGKCKSFSLGISSRVTSQLNLLDLRIFFSFTGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQEPRRHGG

SEQ ID NO: 817756 - protein, 2411 aa, Homo sapiens; identical to SEQ ID NO: 817744

SEQ ID NO: 817757 - protein, 991 aa, Homo sapiens
MDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQEPRRHGG

SEQ ID NO: 817758 - protein, 757 aa, Homo sapiens
MTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQEPRRHGG

SEQ ID NO: 817759 - protein, 903 aa, Homo sapiens
QINAILTSTPISGLSYKQEIQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQEPRRHGG

SEQ ID NO: 817760 - protein, 613 aa, Homo sapiens
MMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 817761 - protein, 842 aa, Homo sapiens
RGRGTIWGLACAMGRPRAFVVGPLICVQHFICSVHEMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 817762 - protein, 775 aa, Homo sapiens
NSESGESQRGQALGSGASTAPLIPRQGLGGNEPGEPGPEPTEPGAAEPPAPRPPPPPPPPPPPPARSLSRRGGGERSERSAAAEPREARPGGWGGQPGGLGPGGGVGGGEKTKTGPGLSADETAGIMAAQVAPAAASSLGNPPPPPPSELKKAEQQQREEAGVEAAAAAAAERGEMKAAAGQESEGPAVGPPHPLGKELLDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPVSISAPSER

SEQ ID NO: 817763 - protein, 864 aa, Homo sapiens
NSESGESQRGQALGSGASTAPLIPRQGLGGNEPGEPGPEPTEPGAAEPPAPRPPPPPPPPPPPPARSLSRRGGGERSERSAAAEPREARPGGWGGQPGGLGPGGGVGGGEKTKTGPGLSADETAGIMAAQVAPAAASSLGNPPPPPPSELKKAEQQQREEAGVEAAAAAAAERGEMKAAAGQESEGPAVGPPHPLGKELLDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPATDAPGTSGIDTYDILEP

SEQ ID NO: 817764 - protein, 785 aa, Homo sapiens
NSESGESQRGQALGSGASTAPLIPRQGLGGNEPGEPGPEPTEPGAAEPPAPRPPPPPPPPPPPPARSLSRRGGGERSERSAAAEPREARPGGWGGQPGGLGPGGGVGGGEKTKTGPGLSADETAGIMAAQVAPAAASSLGNPPPPPPSELKKAEQQQREEAGVEAAAAAAAERGEMKAAAGQESEGPAVGPPHPLGKELLDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPPSSPMDQMGKMRPQPYGGT

SEQ ID NO: 817765 - protein, 681 aa, Homo sapiens
NSESGESQRGQALGSGASTAPLIPRQGLGGNEPGEPGPEPTEPGAAEPPAPRPPPPPPPPPPPPARSLSRRGGGERSERSAAAEPREARPGGWGGQPGGLGPGGGVGGGEKTKTGPGLSADETAGIMAAQVAPAAASSLGNPPPPPPSELKKAEQQQREEAGVEAAAAAAAERGEMKAAAGQESEGPAVGPPHPLGKELLDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQHKLSTAHTRAYSISRYRL

SEQ ID NO: 817766 - protein, 648 aa, Homo sapiens
NSESGESQRGQALGSGASTAPLIPRQGLGGNEPGEPGPEPTEPGAAEPPAPRPPPPPPPPPPPPARSLSRRGGGERSERSAAAEPREARPGGWGGQPGGLGPGAGWEGEEKTKTGPGLSADETAGIMAAQVAPAAASSLGNPPPPPPSELKKAEQQQREEAGVEAAAAAAAERGEMKAAAGQESEGPAVGPPHPLGKELLDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSMRPTSFCSLSTCYPASQHPGPNFHCLEFPWL

SEQ ID NO: 817767 - protein, 109 aa, Homo sapiens
MRPCMLAFYTHHQCIASHKTLHLSSCRRVSAKSIFSFPTDSSLWTTRPQRVWSTGPDSILQPAKSSPSAAAATLLPATTVPDPSCPTFVSAAATVSTTTAPVLSASILP

SEQ ID NO: 817768 - protein, 498 aa, Homo sapiens
AWVAHPAPGGTGRQLPSAPVTCLELEEVGIPLPTPGTGGAAPRGFQDLSSGSWTRSDRGRASWRREARRRPREAQLLGATGMARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGMSRNAIIFLVLGILVFLILLGIGIYFYWSKCSREVLWHCHLCPSSTEHASASANGHVSYSAVSRENSSSQDPQTEGTR

SEQ ID NO: 817769 - protein, 473 aa, Homo sapiens
AWVAHPAPGGTGRQLPSAPVTCLELEEVGIPLPTPGTGGAAPRGFQDLSSGSWTRSDRGRASWRREARRRPREAQLLGATGMARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGMSRNAIIFLVLGILVFLILLGIGIYFYWSKCSREVLWHCHLCPSSEHHQSCRN

SEQ ID NO: 817770 - protein, 498 aa, Homo sapiens; identical to SEQ ID NO: 817768

SEQ ID NO: 817771 - protein, 498 aa, Homo sapiens; identical to SEQ ID NO: 817768

SEQ ID NO: 817772 - protein, 498 aa, Homo sapiens; identical to SEQ ID NO: 817768

SEQ ID NO: 817773 - protein, 445 aa, Homo sapiens
AWVAHPAPGGTGRQLPSAPVTCLELEEVGIPLPTPGTGGAAPRGFQDLSSGSWTRSDRGRASWRREARRRPREAQLLGATGMARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKGTEHASASANGHVSYSAVSRENSSSQDPQTEGTR

SEQ ID NO: 817774 - protein, 498 aa, Homo sapiens; identical to SEQ ID NO: 817768

SEQ ID NO: 817775 - protein, 370 aa, Homo sapiens
AWVAHPAPGGTGRQLPSAPVTCLELEEVGIPLPTPGTGGAAPRGFQDLSSGSWTRSDRGRASWRREARRRPREAQLLGATGMARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTYRACQRLS

SEQ ID NO: 817776 - protein, 135 aa, Homo sapiens [sequence omitted]

SEQ ID NO: 817777 - protein, 498 aa, Homo sapiens; identical to SEQ ID NO: 817768

SEQ ID NO: 817778 - protein, 498 aa, Homo sapiens; identical to SEQ ID NO: 817768

SEQ ID NO: 817779 - protein, 498 aa, Homo sapiens; identical to SEQ ID NO: 817768

SEQ ID NO: 817780 - protein, 498 aa, Homo sapiens; identical to SEQ ID NO: 817768

SEQ ID NO: 817781 - protein, 71 aa, Homo sapiens
KVEHESFEKPQLLTVNLTVYCECAQVSDGKNPCRAAPTTVYTDSPRHCRHCFHHLHRLPRLLSTRPTPIVC

SEQ ID NO: 817782 - protein, 126 aa, Homo sapiens
WDYRREPPRPATMPSCTLNECPLLPRRGSLNDLLLLFLFPAKPQNTAEVQKVQLTGEPVPMARCVSTGGRPPAQITWHSDLGGMPNTSQVPGFLSGTVTVTSLWILVPSSQVDGKNVTCKVEHESF

SEQ ID NO: 817783 - protein, 260 aa, Homo sapiens [sequence omitted]

SEQ ID NO: 817784 - protein, 260 aa, Homo sapiens [sequence omitted]

SEQ ID NO: 817785 - protein, 242 aa, Homo sapiens
MATPPKRSCPSFSASSEGTRIKKISIEGNIAAGKSTFVNILKQLCEDWEVVPEPVARWCNVQSTQDEFEKPERWSFTFQTYACLSRIRAQLASLNGKLKDAEKPVLFFERSVYSDRYIFASNLYESECMNETEWTIYQDWHDWMNNQFGQSLELDGIIYLQATPETCLHRIYLRGRNEEQGIPLEYLEKLHYKHESWLLHRTLKTNFDYLQEVPILTLDVNEDFKDKYESLVEKVKEFLSTL

SEQ ID NO: 817786 - protein, 1464 aa, Homo sapiens [sequence omitted]

SEQ ID NO: 817787 - protein, 1124 aa, Homo sapiens
MLKIMQDYDWHVFSLVTTIFPGYREFISFVKTTVDNSFVGWDMQNVITLDTSFEDAKTQVQLKKIHSSVILLYCSKDEAVLILSEARSLGLTGYDFFWIVPSLVSGNTELIPKEFPSGLISVSYDDWDYSLEARVRDGIGILTTAASSMLEKFSYIPEAKASCYGQMERPEVPMHTLHPFMVNVTWDGKDLSFTEEGYQVHPRLVVIVLNKDREWEKVGKWENHTLSLRHAVWPRYKSFSDCEPDDNHLSIVTLEEAPFVIVEDIDPLTETCVRNTVPCRKFVKINNSTNEGMNVKKCCKGFCIDILKKLSRTVKFTYDLYLVTNGKHGKKVNNVWNGMIGEVVYQRAVMAVGSLTINEERSEVVDFSVPFVETGISVMVSRSNGTVSPSAFLEPFSASVWVMMFVMLLIVSAIAVFVFEYFSPVGYNRNLAKGKAPHGPSFTIGKAIWLLWGLVFNNSVPVQNPKGTTSKIMVSVWAFFAVIFLASYTANLAAFMIQEEFVDQVTGLSDKKFQRPHDYSPPFRFGTVPNGSTERNIRNNYPYMHQYMTKFNQKGVEDALVSLKTGKLDAFIYDAAVLNYKAGRDEGCKLVTIGSGYIFATTGYGIALQKGSPWKRQIDLALLQFVGDGEMEELETLWLTGICHNEKNEVMSSQLDIDNMAGVFYMLAAAMALSLITFIWEHLFYWKLRFCFTGVCSDRPGLLFSISRGIYSCIHGVHIEEKKKSPDFNLTGSQSNMLKLLRSAKNISSMSNMNSSRMDSPKRAADFIQRGSLIMDMVSDKGNLMYSDNRSFQGKESIFGDNMNELQTFVANRQKDNLNNYVFQGQHPLTLNESNPNTVEVAVSTESKANSRPRQLWKKSVDSIRQDSLSQNPVSQRDEATAENRTHSLKSPRYLPEEMAHSDISETSNRATCHREPDNSKNHKTKDNFKRSVASKYPKDCSEVERTYLKTKSSSPRDKIYTIDGEKEPGFHLDPPQFVENVTLPENVDFPDPYQDPSENFRKGDSTLPMNRNPLHNEEGLSNNDQYKLYSKHFTLKDKGSPHSETSERYRQNSTHCRSCLSNMPTYSGHFTMRSPFKCDACLRMGNLYDIDEDQMLQETGMTNAWLLGDAPRTLTNTRCHPRR

SEQ ID NO: 817788 - protein, 510 aa, Homo sapiens
MFWSSLPVNVVICPGEMEELETLWLTGICHNEKNEVMSSQLDIDNMAGVFYMLAAAMALSLITFIWEHLFYWKLRFCFTGVCSDRPGLLFSISRGIYSCIHGVHIEEKKKSPDFNLTGSQSNMLKLLRSAKNISSMSNMNSSRMDSPKRAADFIQRGSLIMDMVSDKGNLMYSDNRSFQGKESIFGDNMNELQTFVANRQKDNLNNYVFQGQHPLTLNESNPNTVEVAVSTESKANSRPRQLWKKSVDSIRQDSLSQNPVSQRDEATAENRTHSLKSPRYLPEEMAHSDISETSNRATCHREPDNSKNHKTKDNFKRSVASKYPKDCSEVERTYLKTKSSSPRDKIYTIDGEKEPGFHLDPPQFVENVTLPENVDFPDPYQDPSENFRKGDSTLPMNRNPLHNEEGLSNNDQYKLYSKHFTLKDKGSPHSETSERYRQNSTHCRSCLSNMPTYSGHFTMRSPFKCDACLRMGNLYDIDEDQMLQETGMTNAWLLGDAPRTLTNTRCHPRR

SEQ ID NO: 817789 - protein, 271 aa, Homo sapiens
MLKIMQDYDWHVFSLVTTIFPGYREFISFVKTTVDNSFVGWDMQNVITLDTSFEDAKTQVQLKKIHSSVILLYCSKDEAVLILSEARSLGLTGYDFFWIVPSLVSGNTELIPKEFPSGLISVSYDDWDYSLEARVRDGIGILTTAASSMLEKFSYIPEAKASCYGQMERPEVPMHTLHPFMVNVTWDGKDLSFTEEGYQVHPRLVVIVLNKDREWEKVSILLCAECRGGKKAWAIKGLTVLLSPTHFLLSCSRSHLTAKSTSFLQQGRLNL

SEQ ID NO: 817790 - protein, 198 aa, Homo sapiens
DPTSTFFQFGASIQQQATVMLKIMQDYDWHVFSLVTTIFPGYREFISFVKTTVDNSFVGWDMQNVITLDTSFEDAKTQVQLKKIHSSVILLYCSKDEAVLILSEARSLGLTGYDFFWIVPSLVSGNTELIPKEFPSGLISVSYDDWDYSLEARVRDGIGILTTAASSMLEKFSYIPEAKASCYGQMERPEVPMHTLHP

SEQ ID NO: 817791 - protein, 926 aa, Homo sapiens
MSRRRKHDDSPSPKKTPHKTVAAEECGSVVEPGRRRLRSARGSWPCGAREGPPGPVRQREQPPTAALCSKSNPEERYETPKRALKMDSLSSSFSSPNDPDGQNDIFWDQNSPLTKQLGKGRKKQIYTTDSDEISHIVNRIAPQDEKPTTNSMLDMWIGETAIPCTPSVAKGKSRAKISCTKLKTQSQEEELMKLAKQFDKNMEELDVIQEQNKRNYDFTQMISETEILSNYKDNIQMWSLHNIVPEIDNATKKPIKGNTKISVANNQNSSQKPFDQIAEAAFNAIFDGSTQKCSGQLSQELPEAFWSTSNTTFVKTNALKEEKIITNETLVIEKLSNKTPRSLSSQVDTPIMTKSCVTSCTKEPETSNKYIDAFTTSDFEDDWENLLGSEPFAMQNIDMPELFPSKTAHVTDQKEICTFNSKTVKNTSRANTSPDARLGDSKVLQDLSSKTYDRELIDAEYRFSPNSNKSNKLSTGNKMKFENSSNKIVIQDEIQNCIVTSNLTKIKEDILTNSTEASERKSALNTRYSNEQKNKCILNQSIKAPVNTDLFGSANLGSKTSVSNPNQTSASKVGSFFDDWNDPSFANEIIKACHQLDNTWEADDVDDDLLYQACDDIERLTQQQDIRKDSKTSESICEINNNSEHGAKLTQQQDIRKDSKTSESICEINNNSEHGAKNMFAISKQGSNLVQSKHLNPGSISVQTSLTNSSQIDKPMKMEKGEMYGNSPRFLGATNLTMYSKISNCQINNLHVSYTNTDVPIQVNSSKLVLPGSSSLNVTSDHMNTEITTYKKKLSTNQPCHKTVTDEAQSNLNTTVGFSKFTFTRMKNSQILSQFNQNCITGSMSDTKITQGVEKKKGVNPLLEEAVGQQSLVKLSESLKQSSKEEEEKNRKCSPEEIQRKRQEALVRRMAKARASSVNAAPTSFL

SEQ ID NO: 817792 - protein, 179 aa, Homo sapiens
MSRRRKHDDSPSPKKTPHKTVAAEECGSVVEPGRRRLRSARGSWPCGAREGPPGPVRQREQPPTAALCSKSNPEGETSAARPALASAPHPHIPACNREIWGGGGVWSVYSVSGIPLNHRESKNNPIPLPDGAFVPELQHYPVRFDHPFASATGIGNVVYLFAGGRLLSRLLLQSAAVVE

SEQ ID NO: 817793 - protein, 841 aa, Homo sapiens
MDSLSSSFSSPNDPDGQNDIFWDQNSPLTKQLGKGRKKQIYTTDSDEISHIVNRIAPQDEKPTTNSMLDMWIGETAIPCTPSVAKGKSRAKISCTKLKTQSQEEELMKLAKQFDKNMEELDVIQEQNKRNYDFTQMISETEILSNYKDNIQMWSLHNIVPEIDNATKKPIKGNTKISVANNQNSSQKPFDQIAEAAFNAIFDGSTQKCSGQLSQELPEAFWSTSNTTFVKTNALKEEKIITNETLVIEKLSNKTPRSLSSQVDTPIMTKSCVTSCTKEPETSNKYIDAFTTSDFEDDWENLLGSEPFAMQNIDMPELFPSKTAHVTDQKEICTFNSKTVKNTSRANTSPDARLGDSKVLQDLSSKTYDRELIDAEYRFSPNSNKSNKLSTGNKMKFENSSNKIVIQDEIQNCIVTSNLTKIKEDILTNSTEASERKSALNTRYSNEQKNKCILNQSIKAPVNTDLFGSANLGSKTSVSNPNQTSASKVGSFFDDWNDPSFANEIIKACHQLDNTWEADDVDDDLLYQACDDIERLTQQQDIRKDSKTSESICEINNNSEHGAKLTQQQDIRKDSKTSESICEINNNSEHGAKNMFAISKQGSNLVQSKHLNPGSISVQTSLTNSSQIDKPMKMEKGEMYGNSPRFLGATNLTMYSKISNCQINNLHVSYTNTDVPIQVNSSKLVLPGSSSLNVTSDHMNTEITTYKKKLSTNQPCHKTVTDEAQSNLNTTVGFSKFTFTRMKNSQILSQFNQNCITGSMSDTKITQGVEKKKGVNPLLEEAVGQQSLVKLSESLKQSSKEEEEKNRKCSPEEIQRKRQEALVRRMAKARASSVNAAPTSFL

SEQ ID NO: 817794 - protein, 823 aa, Homo sapiens
MDSLSSSFSSPNDPDGQNDIFWDQNSPLTKQLGKGRKKQIYTTDSDEISHIVNRIAPQDEKPTTNSMLDMWIGETAIPCTPSVAKGKSRAKISCTKLKTQSQEEELMKLAKQFDKNMEELDVIQEQNKRNYDFTQMISETEILSNYKDNIQMWSLHNIVPEIDNATKKPIKGNTKISVANNQNSSQKPFDQIAEAAFNAIFDGSTQKCSGQLSQELPEAFWSTSNTTFVKTNALKEEKIITNETLVIEKLSNKTPRSLSSQVDTPIMTKSCVTSCTKEPETSNKYIDAFTTSDFEDDWENLLGSEPFAMQNIDMPELFPSKTAHVTDQKEICTFNSKTVKNTSRANTSPDARLGDSKVLQDLSSKTYDRELIDAEYRFSPNSNKSNKLSTGNKMKFENSSNKIVIQDEIQNCIVTSNLTKIKEDILTNSTEASERKSALNTRYSNEQKNKCILNQSIKAPVNTDLFGSANLGSKTSVSNPNQTSASKVGSFFDDWNDPSFANEIIKACHQLDNTWEADDVDDDLLYQACDDIERLTQQQDIRKDSKTSESICEINNNSEHGAKLTQQQDIRKDSKTSESICEINNNSEHGAMNPGSISVQTSLTNSSQIDKPMKMEKGEMYGNSPRFLGATNLTMYSKISNCQINNLHVSYTNTDVPIQVNSSKLVLPGSSSLNVTSDHMNTEITTYKKKLSTNQPCHKTVTDEAQSNLNTTVGFSKFTFTRMKNSQILSQFNQNCITGSMSDTKITQGVEKKKGVNPLLEEAVGQQSLVKLSESLKQSSKEEEEKNRKCSPEEIQRKRQEALVRRMAKARASSVNAAPTSFL

SEQ ID NO: 817795 - protein, 144 aa, Homo sapiens [sequence omitted]

SEQ ID NO: 817796 - protein, 841 aa, Homo sapiens; identical to SEQ ID NO: 817793

SEQ ID NO: 817797 - protein, 761 aa, Homo sapiens
MDSLSSSFSSPNDPDGQNDIFWDQNSPLTKQLGKGRKKQIYTTDSDEISHIVNRIAPQDEKPTTNSMLDMWIGETAIPCTPSVAKGKSRAKISCTKLKTQSQEEELMKLAKQFDKNMEELDVIQEQNKRNYDFTQMISETEILSNYKDNIQMWSLHNIVPEIDNATKKPIKGNTKISVANNQNSSQKPFDQIAEAAFNAIFDGSTQKCSGQLSQELPEAFWSTSNTTFVKTNALKEEKIITNETLVIEKLSNKTPRSLSSQVDTPIMTKSCVTSCTKEPETSNKYIDAFTTSDFEDDWENLLGSEPFAMQNIDMPELFPSKTAHVTDQKEICTFNSKTVKNTSRANTSPDARLGDSKVLQDLSSKTYDRELIDAEYRFSPNSNKSNKLSTGNKMKFENSSNKIVIQDEIQNCIVTSNLTKIKEDILTNSTEASERKSALNTRYSNEQKNKCILNQSIKAPVNTDLFGSANLGSKTSVSNPNQTSASKVGSFFDDWNDPSFANEIIKACHQLDNTWEADDVDDDLLYQACDDIERLTQQQDIRKDSKTSESICEINNNSEHGAKLTQQQDIRKDSKTSESICEINNNSEHGAMNPGSISVQTSLTNSSQIDKPMKMEKGEMYGNSPRFLGATNLTMYSKISNCQINNLHVSYTNTDVPIQVNSSKLVLPGSSSLNVTSDHMNTEITTYKKKLSTNQPCHKTVTDEAQSNLNTTVGFSKFTFTRMKNSQILSQFNQNCITGSMSDTAVPQHSLLKLSELLNQS

SEQ ID NO: 817798 - protein, 87 aa, Homo sapiens
MLEIKRGRRTHKHDGSNTNTTATQGGRGSQQHKSRRRSNKHGGVGRDTETNKHTYGAEKQHRKATTTHQEESRPQRGGKQKPTVRAV

SEQ ID NO: 817799 - protein, 73 aa, Homo sapiens
MDRTLTQQQRRAGGDHSNTKADGEATNTEAEDATRKRTNTHTGRRSNTARQPPPTKRKVDHREAENKNPPYEQ

SEQ ID NO: 817800 - protein, 331 aa, Homo sapiens
MGGEQEEERFDGMLLAMAQQHEGGVQELVNTFFSFLRRKTDFFIGGEEGMAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELDLAVPFCVNFRLKGKDMVVDIQRRHLRVGLKGQPAIIDGELYNEVKVEESSWLIEDGKVVTVHLEKINKMEWWSRLVSSDPEINTKKINPENSKLSDLDSETRSMVEKMMYDQRQKSMGLPTSDEQKKQEILKKFMDQHPEMDFSKAKFN

SEQ ID NO: 817801 - protein, 331 aa, Homo sapiens; identical to SEQ ID NO: 817800

SEQ ID NO: 817802 - protein, 282 aa, Homo sapiens
MGGEQEEERFDGMLLAMAQQHEGGVQELVNTFFSFLRRKTDFFIGGEEGMAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELDLAVPFCVNFRLKGKDMVVDIQRRHLRVGLKGQPAIIDGELYNEVKVEESSWLIEDGKVVTVHLEKPPEEWGAVVSMNLINRKLPKSMCRRNPCGKFFPNL

SEQ ID NO: 817803 - protein, 71 aa, Homo sapiens
GCESDEEKINPENSKLSDLDSETRSMVEKMMYDQRQKSMGLPTSDEQKKQEILKKFMDQHPEMDFSKAKFN

SEQ ID NO: 817804 - protein, 71 aa, Homo sapiens; identical to SEQ ID NO: 817803

SEQ ID NO: 817805 - protein, 62 aa, Homo sapiens
MGGEQEEERFDGMLLAMAQQHEGGVQELVNTFFSFLRRKTDFFIGGEEGMAEKVSVGNHCPL

SEQ ID NO: 817806 - protein, 331 aa, Homo sapiens; identical to SEQ ID NO: 817800

SEQ ID NO: 817807 - protein, 331 aa, Homo sapiens; identical to SEQ ID NO: 817800

SEQ ID NO: 817808 - protein, 315 aa, Homo sapiens
MGGEQEEERFDGMLLAMAQQHEGGVQELVNTFFSFLRRKTDFFIGGEEGMAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELDLAVPFCVNFRLKGKDMVVDIQRRHLRVGLKGQPAIIDGELYNEVKVEESSWLIEDGKVVTVHLEKINKMEWWSRLVSSDPEINTKKINPENSKLSDLDSETRSMVEKMMYDQRQKSMGLPTSDEQKKQEILKK

SEQ ID NO: 817809 - protein, 312 aa, Homo sapiens
MGGEQEEERFDGMLLAMAQQHEGGVQELVNTFFSFLRRKTDFFIGGEEGMAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELDLAVPFCVNFRLKGKDMVVDIQRRHLRVGLKGQPAIIDGELYNEVKVEESSWLIEDGKVVTVHLEKINKMEWWSRLVSSDPEINTKKINPENSKVSPGWLGELQQEGEGPRCFQSFTDSCHCLPSAVRPGQ

SEQ ID NO: 817810 - protein, 312 aa, Homo sapiens; identical to SEQ ID NO: 817809

SEQ ID NO: 817811 - protein, 331 aa, Homo sapiens; identical to SEQ ID NO: 817800

SEQ ID NO: 817812 - protein, 388 aa, Homo sapiens
MGGEQEEERFDGMLLAMAQQHEGGVQELVNTFFSFLRRKTDFFIGGEEGMAEKIGRRENECQQKKCQTLIKPSDLVRTHSYHENSMGETILVIQLPPPGTAFDMWELQFKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELDLAVPFCVNFRLKGKDMVVDIQRRHLRVGLKGQPAIIDGELYNEVKVEESSWLIEDGKVVTVHLEKINKMEWWSRLVSSDPEINTKKINPENSKLSDLDSETRSMVEKMMYDQRQKSMGLPTSDEQKKQEILKKFMDQHPEMDFSKAKFN

SEQ ID NO: 817813 - protein, 362 aa, Homo sapiens
MGGEQEEERFDGMLLAMAQQHEGGVQELVNTFFSFLRRKTDFFIGGEEGMAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELDVSVRDQRKSLGGSLGYQQHLVASSDCLCPMQLAVPFCVNFRLKGKDMVVDIQRRHLRVGLKGQPAIIDGELYNEVKVEESSWLIEDGKVVTVHLEKINKMEWWSRLVSSDPEINTKKINPENSKLSDLDSETRSMVEKMMYDQRQKSMGLPTSDEQKKQEILKKFMDQHPEMDFSKAKFN

SEQ ID NO: 817814 - protein, 309 aa, Homo sapiens
MGGEQEEERFDGMLLAMAQQHEGGVQELVNTFFSFLRRKTDFFIGGEEGMAEKLITQTFSHHNQLAQKTRREKRARQEAERREKAERAARLAKEAKSETSGPQIKELTDEEAERLQLEIDQDTEEDEEEDEKDKGKLKPNLGNGADLPNYRWTQTLSELDLAVPFCVNFRLKGKDMVVDIQRRHLRVGLKGQPAIIDGELYNEVKVEESSWLIEDGKVVTVHLEKINKMEWWSRLVSSDPEINTKKINPENSKLSDLDSETRSMVEKMMYDQRQKSMGLPTSDEQKKQEILKKFMDQHPEMDFSKAKFN

SEQ ID NO: 817815 - protein, 182 aa, Homo sapiens
AGTLDDPVWREANPSNGADLPNYRWTQTLSELDLAVPFCVNFRLKGKDMVVDIQRRHLRVGLKGQPAIIDGELYNEVKVEESSWLIEDGKVVTVHLEKINKMEWWSRLVSSDPEINTKKINPENSKLSDLDSETRSMVEKMMYDQRQKSMGLPTSDEQKKQEILKKFMDQHPEMDFSKAKFN

SEQ ID NO: 817816 - protein, 136 aa, Homo sapiens
WCRNPPPPPPGGPPDALRKTRLRIGELYNEVKVEESSWLIEDGKVVTVHLEKINKMEWWSRLVSSDPEINTKKINPENSKLSDLDSETRSMVEKMMYDQRQKSMGLPTSDEQKKQEILKKFMDQHPEMDFSKAKFN

SEQ ID NO: 817817 - protein, 120 aa, Homo sapiens
PSTSDGVALQVTLAVVRGPRGVPFVRHGRDWASPSQINKMEWWSRLVSSDPEINTKKINPENSKLSDLDSETRSMVEKMMYDQRQKSMGLPTSDEQKKQEILKKFMDQHPEMDFSKAKFN

SEQ ID NO: 817818 - protein, 388 aa, Homo sapiens
MRARRGLLRLPRRSLLAALFFFSLSSSLLYFVYVAPGIVNTYLFMMQAQGILIRDNVRTIGAQVYEQVLRSAYAKRNSSVNDSDYPLDLNHSETFLQTTTFLPEDFTYFANHTCPERLPSMKGPIDINMSEIGMDYIHELFSKDPTIKLGGHWKPSDCMPRWKVAILIPFRNRHEHLPVLFRHLLPMLQRQRLQFAFYVVEQVGTQPFNRAMLFNVGFQEAMKDLDWDCLIFHDVDHIPESDRNYYGCGQMPRHFATKLDKYMYLLPYTEFFGGVSGLTVEQFRKINGFPNAFWGWGGEDDDLWNRVQNAGYSVSRPEGDTGKYKSIPHHHRGEVQFLGRYALLRKSKERQGLDGLNNLNYFANITYDALYKNITVNLTPELAQVNEY

SEQ ID NO: 817819 - protein, 388 aa, Homo sapiens; identical to SEQ ID NO: 817818

SEQ ID NO: 817820 - protein, 388 aa, Homo sapiens; identical to SEQ ID NO: 817818

SEQ ID NO: 817821 - protein, 83 aa, Homo sapiens
AAVGDRHRACESRRVDPGKLHADGSGPFSVQSKEIKQAGSNTRRGGAPSFRKVSRPDRPSSGSLTGKPHAQTPSLDQPLELRE

SEQ ID NO: 817822 - protein, 388 aa, Homo sapiens; identical to SEQ ID NO: 817818

SEQ ID NO: 817823 - protein, 388 aa, Homo sapiens; identical to SEQ ID NO: 817818

SEQ ID NO: 817824 - protein, 388 aa, Homo sapiens; identical to SEQ ID NO: 817818

SEQ ID NO: 817825 - protein, 1244 aa, Homo sapiens
DVGGDRPWDSGNTQLPPRNPVKANAMFGAGDEDDTDFLSPSGGARLASLFGLDQAAAGHGNEFFQYTAPKQPKKGQGTAATGNQATPKTAPATMSTPTILVATAVHAYRYTNGQYVKQGKFGAAVLGNHTAREYRILLYISQQQPVTVARIHVNFELMVRPNNYSTFYDDQRQNWSIMFESEKAAVEFNKQVCIAKCNSTSSLDAVLSQDLIVADGPAVEVGDSLEVAYTGWLFQNHVLGQVFDSTANKDKLLRLKLGSGKVIKGWEDGMLGMKKGGKRLLIVPPACAVGSEGVIGWTQATDSILVFEVEVRRVKFARDSGSDGHSVSSRDSAAPSPIPGADNLSADPVVSPPTSIPFKSGEPALRTKSNSLSEQLAINTSPDAVKAKLISRMAKMGQPMLPILPPQLDSNDSEIEDVNTLQGGGQPVVTPSVQPSLHPAHPALPQMTSQAPQPSVTGLQAPSAALMQVSSLDSHSAVSGNAQSFQPYAGMQAYAYPQASAVTSQLQPVRPLYPAPLSQPPHFQGSGDMASFLMTEARQHNTEIRMAVSKVADKMDHLMTKVEELQKHSAGNSMLIPSMSVTMETSMIMSNIQRIIQENERLKQEILEKSNRIEEQNDKISELIERNQRYVEQSNLMMEKRNNSLQTATENTQARVLHAEQEKAKVTEELAAATAQVSHLQLKMTAHQKKETELQMQLTESLKETDLLRGQLTKVQAKLSELQETSEQAQSKFKSEKQNRKQLELKVTSLEEELTDLRVEKESLEKNLSERKKKSAQERSQAEEEIDEIRKSYQEELDKLRQLLKKTRVSTDQAAAEQLSLVQAELQTQWEAKCEHLLASAKDEHLQQYQEVCAQRDAYQQKLVQLQEKCLALQAQITALTKQNEQHIKELEKNKSQMSGVEAAASDPSEKVKKIMNQVFQSLRREFELEESYNGRTILGTIMNTIKMVTLQLLNQQEQEKEESSSEEEEEKAEERPRRPSQEQSASASSGQPQAPLNRERPESPMVPSEQVVEEAVPLPPQALTTSQDGHRRKGDSEAEALSEIKDGSLPPELSCIPSHRVLGPPTSIPPEPLGPVSMDSECEESLAASPMAAKPDNPSGKVCVREVAPDGPLQESSTRLSLTSDPEEGDPLALGPESPGEPQPPQLKKDDVTSSTGPHKELSSTEAGSTVAGAALRPSHHSQRSSLSGDEEDELFKGATLKALRPKAQPEEEDEDEVSMKGRPPPTPLFGDDDDDDDIDWLG

SEQ ID NO: 817826 - protein, 798 aa, Homo sapiens
MTSQAPQPSVTGLQAPSAALMQVSSLDSHSAVSGNAQSFQPYAGMQAYAYPQASAVTSQLQPVRPLYPAPLSQPPHFQGSGDMASFLMTEARQHNTEIRMAVSKVADKMDHLMTKVEELQKHSAGNSMLIPSMSVTMETSMIMSNIQRIIQENERLKQEILEKSNRIEEQNDKISELIERNQRYVEQSNLMMEKRNNSLQTATENTQARVLHAEQEKAKVTEELAAATAQVSHLQLKMTAHQKKETELQMQLTESLKETDLLRGQLTKVQAKLSELQETSEQAQSKFKSEKQNRKQLELKVTSLEEELTDLRVEKESLEKNLSERKKKSAQERSQAEEEIDEIRKSYQEELDKLRQLLKKTRVSTDQAAAEQLSLVQAELQTQWEAKCEHLLASAKDEHLQQYQEVCAQRDAYQQKLVQLQEKCLALQAQITALTKQNEQHIKELEKNKSQMSGVEAAASDPSEKVKKIMNQVFQSLRREFELEESYNGRTILGTIMNTIKMVTLQLLNQQEQEKEESSSEEEEEKAEERPRRPSQEQSASASSGQPQAPLNRERPESPMVPSEQVVEEAVPLPPQALTTSQDGHRRKGDSEAEALSEIKDGSLPPELSCIPSHRVLGPPTSIPPEPLGPVSMDSECEESLAASPMAAKPDNPSGKVCVREVAPDGPLQESSTRLSLTSDPEEGDPLALGPESPGEPQPPQLKKDDVTSSTGPHKELSSTEAGSTVAGAALRPSHHSQRSSLSGDEEDELFKGATLKALRPKAQPEEEDEDEVSMKGRPPPTPLFGDDDDDDDIDWLG

SEQ ID NO: 817827 - protein, 690 aa, Homo sapiens
MDHLMTKVEELQKHSAGNSMLIPSMSVTMETSMIMSNIQRIIQENERLKQEILEKSNRIEEQNDKISELIERNQRYVEQSNLMMEKRNNSLQTATENTQARVLHAEQEKAKVTEELAAATAQVSHLQLKMTAHQKKETELQMQLTESLKETDLLRGQLTKVQAKLSELQETSEQAQSKFKSEKQNRKQLELKVTSLEEELTDLRVEKESLEKNLSERKKKSAQERSQAEEEIDEIRKSYQEELDKLRQLLKKTRVSTDQAAAEQLSLVQAELQTQWEAKCEHLLASAKDEHLQQYQEVCAQRDAYQQKLVQLQEKCLALQAQITALTKQNEQHIKELEKNKSQMSGVEAAASDPSEKVKKIMNQVFQSLRREFELEESYNGRTILGTIMNTIKMVTLQLLNQQEQEKEESSSEEEEEKAEERPRRPSQEQSASASSGQPQAPLNRERPESPMVPSEQVVEEAVPLPPQALTTSQDGHRRKGDSEAEALSEIKDGSLPPELSCIPSHRVLGPPTSIPPEPLGPVSMDSECEESLAASPMAAKPDNPSGKVCVREVAPDGPLQESSTRLSLTSDPEEGDPLALGPESPGEPQPPQLKKDDVTSSTGPHKELSSTEAGSTVAGAALRPSHHSQRSSLSGDEEDELFKGATLKALRPKAQPEEEDEDEVSMKGRPPPTPLFGDDDDDDDIDWLG

SEQ ID NO: 817828 - protein, 624 aa, Homo sapiens
MQVEGSHNSLFTSSVYIELCEVGSSPAWRTPMFKVTSYFVIIQAKVTEELAAATAQVSHLQLKMTAHQKKETELQMQLTESLKETDLLRGQLTKVQAKLSELQETSEQAQSKFKSEKQNRKQLELKVTSLEEELTDLRVEKESLEKNLSERKKKSAQERSQAEEEIDEIRKSYQEELDKLRQLLKKTRVSTDQAAAEQLSLVQAELQTQWEAKCEHLLASAKDEHLQQYQEVCAQRDAYQQKLVQLQEKCLALQAQITALTKQNEQHIKELEKNKSQMSGVEAAASDPSEKVKKIMNQVFQSLRREFELEESYNGRTILGTIMNTIKMVTLQLLNQQEQEKEESSSEEEEEKAEERPRRPSQEQSASASSGQPQAPLNRERPESPMVPSEQVVEEAVPLPPQALTTSQDGHRRKGDSEAEALSEIKDGSLPPELSCIPSHRVLGPPTSIPPEPLGPVSMDSECEESLAASPMAAKPDNPSGKVCVREVAPDGPLQESSTRLSLTSDPEEGDPLALGPESPGEPQPPQLKKDDVTSSTGPHKELSSTEAGSTVAGAALRPSHHSQRSSLSGDEEDELFKGATLKALRPKAQPEEEDEDEVSMKGRPPPTPLFGDDDDDDDIDWLG

SEQ ID NO: 817829 - protein, 1244 aa, Homo sapiens; identical to SEQ ID NO: 817825

SEQ ID NO: 817830 - protein, 1270 aa, Homo sapiens
DVGGDRPWDSGNTQLPPRNPVKANAMFGAGDEDDTDFLSPSGGARLASLFGLDQAAAGHGNEFFQYTAPKQPKKGQGTAATGNQATPKTAPATMSTPTILVATAVHAYRYTNGQYVKQGKFGAAVLGNHTAREYRILLYISQQQPVTVARIHVNFELMVRPNNYSTFYDDQRQNWSIMFESEKAAVEFNKQVCIAKCNSTSSLDAVLSQDLIVADGPAVEVGDSLEVAYTGWLFQNHVLGQVFDSTANKDKLLRLKLGSGKVIKGWEDGMLGMKKGGKRLLIVPPACAVGSEGVIGWTQATDSILVFEVEVRRVKFARDSGSDGHSVSSRDSAAPSPIPGADNLSADPVVSPPTSIPFKSGEPALRTKSNSLSEQLAINTSPDAVKAKLISRMAKMGQPMLPILPPQLDSNDSEIEDVNTLQGGGQPVVTPSVQPSLHPAHPALPQMTSQAPQPSVTGLQAPSAALMQVSSLDSHSAVSGNAQSFQPYAGMQAYAYPQASAVTSQLQPVRPLYPAPLSQPPHFQGSGDMASFLMTEARQHNTEIRMAVSKVADKMDHLMTKVEELQKHSAGNSMLIPSMSVTMETSMIMSNIQRIIQENERLKQEILEKSNRIEEQNDKISELIERNQRYVEQSNLMMEKRNNSLQTATENTQARVLHAEQEKAKVTEELAAATAQVSHLQLKMTAHQKKETELQMQLTESLKETDLLRGQLTKVQAKLSELQETSEQAQSKFKSEKQNRKQLELKVTSLEEELTDLRVEKESLEKNLSERKKKSAQERSQAEEEIDEIRKSYQEELDKLRQLLKKTRVSTDQAAAEQLSLVQAELQTQWEAKCEHLLASAKDEHLQQYQEVCAQRDAYQQKLVQLQEKCLALQAQITALTKQNEQHIKELEKNKSQMSGVEAAASDPSEKVKKIMNQVFQSLRREFELEESYNGRTILGTIMNTIKMVTLQLLNQQEQEKEESSSEEEEEKAEERPRRPSQEQSASASSGQPQAPLNRERPESPMVPSEQVVEEAVPLPPQALTTSQDGHRRKGDSEAEALSEIKDGSLPPELSCIPSHRVLGPPTSIPPEPLGPVSMDSECEESLAASPMAAKPDNPSGKVCVREVAPDGPLQESSTRLSLTSDPEEGDPLALGPESPGEPQPPQLKKDDVTSSTGPHKELSSTEAGSTVAGAALRPSHHSQRSSLSGDEEDELFKGATLKALRPKAQQTVVIVVCVSFLVFMIILGVFRIRAAIGGPVRDQDTGKENEMELGDSAMTISVNIHGGTE

SEQ ID NO: 817831 - protein, 851 aa, Homo sapiens
DVGGDRPWDSGNTQLPPRNPVKANAMFGAGDEDDTDFLSPSGGARLASLFGLDQAAAGHGNEFFQYTAPKQPKKGQGTAATGNQATPKTAPATMSTPTILVATAVHAYRYTNGQYVKQGKFGAAVLGNHTAREYRILLYISQQQPVTVARIHVNFELMVRPNNYSTFYDDQRQNWSIMFESEKAAVEFNKQVCIAKCNSTSSLDAVLSQDLIVADGPAVEVGDSLEVAYTGWLFQNHVLGQVFDSTANKDKLLRLKLGSGKVIKGWEDGMLGMKKGGKRLLIVPPACAVGSEGVIGWTQATDSILVFEVEVRRVKFARDSGSDGHSVSSRDSAAPSPIPGADNLSADPVVSPPTSIPFKSGEPALRTKSNSLSEQLAINTSPDAVKAKLISRMAKMGQPMLPILPPQLDSNDSEIEDVNTLQGGGQPVVTPSVQPSLHPAHPALPQMTSQAPQPSVTGLQAPSAALMQVSSLDSHSAVSGNAQSFQPYAGMQAYAYPQASAVTSQLQPVRPLYPAPLSQPPHFQGSGDMASFLMTEARQHNTEIRMAVSKVADKMDHLMTKVEELQKHSAGNSMLIPSMSVTMETSMIMSNIQRIIQENERLKQEILEKSNRIEEQNDKISELIERNQRYVEQSNLMMEKRNNSLQTATENTQARVLHAEQEKAKVTEELAAATAQVSHLQLKMTAHQKKETELQMQLTESLKETDLLRGQLTKVQAKLSELQETSEQAQSKFKSEKQNRKQLELKVTSLEEELTDLRVEKESLEKNLSERKKKSAQERSQAEEEIDEIRKSYQEELDKLRQLLKKTRVSTDQAAAEQLSLVQAELQTQWEAKCEHLLASAKDEHLPVPAS

SEQ ID NO: 817832 - protein, 166 aa, Homo sapiens
DVGGDRPWDSGNTQLPPRNPVKANAMFGAGDEDDTDFLSPSGGARLASLFGLDQAAAGHGNEFFQYTAPKQPKKGQGTAATGNQATPKTAPATMSTPTILVATAVHAYRYTNGQYVKQGKFGAAVLGNHTAREVRVLPHLMYIQMSQIIPMSWLLSGLPDVLFIRR

SEQ ID NO: 817833 - protein, 234 aa, Homo sapiens
DVGGDRPWDSGNTQLPPRNPVKANAMFGAGDEDDTDFLSPSGGARLASLFGLDQAAAGHGNEFFQYTAPKQPKKGQGTAATGNQATPKTAPATMSTPTILVATAVHAYRYTNGQYVKQGKFGAAVLGNHTAREYRILLYISQQQPVTVARIHVNFELMVRPNNYSTFYDDQRQNWSIMFESEKAAVEFNKQVCIAKCNSTGLSLALSFVACRRNWSFIFKAPYSPSPQRYLLPV

SEQ ID NO: 817834 - protein, 67 aa, Homo sapiens
ALIIAVEQDQLGQGPSVTPAVSPGCANGLSCQNSQNISNSTETSQEKCSTNFRLKKHHWLLTRIPAP

SEQ ID NO: 817835 - protein, 67 aa, Homo sapiens; identical to SEQ ID NO: 817834

SEQ ID NO: 817836 - protein, 153 aa, Homo sapiens
RGGRQSRRSSPRFWSVIVTMSLMVSAGRGLGAVWSPTHVQVTVLQARGLRAKGPGGTSDAYAVIQVGKEKYATSVSERSLGAPVWREEATFELPSLLSSGPAAAATLQLTVLHRALLGLDKFLGRAEVDLRDCTPAWARVFLRLLKKEPGQFF

SEQ ID NO: 817837 - protein, 342 aa, Homo sapiens
RGGRQSRRSSPRFWSVIVTMSLMVSAGRGLGAVWSPTHVQVTVLQARGLRAKGPGGTSDAYAVIQVGKEKYATSVSERSLGAPVWREEATFELPSLLSSGPAAAATLQLTVLHRALLGLDKFLGRAEVDLRDLHRDQGRRRRMEGENPLTVPGREKEGMLMGVKPGEDASGPAEDLVRRSEKDTAAVVSRQGSSLNLFEDVQITEPEAEPESKSEPRPPISSPRAPQTRAVKPRLHPVKPMNATATKVANCSLGTATIISENLNNEVMMKKYSPSDPAFAYAQLTHDELIQLVLKQKETISKKEFQVRELEDYIDNLLVRVMEETPNILRIPTQVGKKAGKM

SEQ ID NO: 817838 - protein, 122 aa, Homo sapiens
MTGGSKDPFPLLFRLHPVKPMNATATKVANCSLGTATIISENLNNEVMMKKYSPSDPAFAYAQLTHDELIQLVLKQKETISKKEFQVRELEDYIDNLLVRVMEETPNILRIPTQVGKKAGKM

SEQ ID NO: 817839 - protein, 667 aa, Homo sapiens
WRPPVAAIFSSLLECYRHHVPNGLGWPGPGGRVVPNPRAGDGAAGAGPAGQGPRGHERRVRGDPGGQGEVRHLRVGAQPGRARVARGGHLRAAIAAVLRTRGRRHPAAHRAAPRAARPRQVPGPRRGGPAGSAPRPGPQKTQWYKLKSKPGKKDKERGEIEVDIQFMRNNMTASMFDLSMKDKSRNPFGKLKDKIKGKNKDSGSDTASAIIPSTTPSVDSDDESVVKDKKKKSKIKTLLSKSNLQKTPLSQSMSVLPTSKPEKVLLRPGDFQSQWDEDDNEDESSSASDVMSHKRTASTDLKQLNQVNFTLPKKEGLSFLGGLRSKNDVLSRSNVCINGNHVYLEQPEAKGEIKDSSPSSSPSPKGFRKKHLFSSTENLAAGSWKEPAEGGGLSSDRQLSESSTKDSLKSMTLPSYRPAPLVSGDLRENMAPANSEATKEAKESKKPESRRSSLLSLMTGKKDVAKGSEGENPLTVPGREKEGMLMGVKPGEDASGPAEDLVRRSEKDTAAVVSRQGSSLNLFEDVQITEPEAEPESKSEPRPPISSPRAPQTRAVKPRLHPVKPMNATATKVANCSLGTATIISENLNNEVMMKKYSPSDPAFAYAQLTHDELIQLVLKQKETISKKEFQVRELEDYIDNLLVRVMEETPNILRIPTQVGKKAGKM

SEQ ID NO: 817840 - protein, 90 aa, Homo sapiens
GENPLTVPGREKEGMLMGVKPGEDASGPAEDLVRRSEKDTAAVVSRQGSSLNLFEDVQITEPEAEPESKSEPRPPISSPRAPQTRAVKPR

SEQ ID NO: 817841 - protein, 667 aa, Homo sapiens; identical to SEQ ID NO: 817839

SEQ ID NO: 817842 - protein, 667 aa, Homo sapiens; identical to SEQ ID NO: 817839

SEQ ID NO: 817843 - protein, 605 aa, Homo sapiens
WRPPVAAIFSSLLECYRHHVPNGLGWPGPGGRVVPNPRAGDGAAGAGPAGQGPRGHERRVRGDPGGQGEVRHLRVGAQPGRARVARGGHLRAAIAAVLRTRGRRHPAAHRAAPRAARPRQVPGPRRGGPAGSAPRPGPQKTQWYKLKSKPGKKDKERGEIEVDIQFMRNNMTASMFDLSMKDKSRNPFGKLKDKIKGKNKDSGSDTASAIIPSTTPSVDSDDESVVKDKKKKSKIKTLLSKSNLQKTPLSQSMSVLPTSKPEKVLLRPGDFQSQWDEDDNEDESSSASDVMSHKRTASTDLKQLNQVNFTLPKKEGLSFLGGLRSKNDVLSRSNVCINGNHVYLEQPEAKGEIKDSSPSSSPSPKGFRKKHLFSSTENLAAGSWKEPAEGGGLSSDRQLSESSTKDSLKSMTLPSYRPAPLVSGDLRENMAPANSEATKEAKESKKPESRRSSLLSLMTGKKDVAKGSEGENPLTVPGREKEGMLMGVKPGEDASGPAEDLVRRSEKDTAAVVSRQGSSLNLFEDVQITEPEAEPESKSEPRPPISSPRAPQTRAVKPRLHPVKPMNATATKVANCSLGTATIISENLNNEVMMKVCPLRSWCVR

SEQ ID NO: 817844 - protein, 54 aa, Homo sapiens
MFDLSMKDKSRNPFGKLKDKIKGKNKDSGSDTASAIIPSTTPSVDSDDESVVKD

SEQ ID NO: 817845 - protein, 113 aa, Homo sapiens
MVGLPGILYRFKIRMRTELFIACRGAFSHWASCVYCGQRRPSSTLAMRPSSTLANVLPCGHHCPEGTIVCCLEEKGYNSCACLGRRTPGRPVAKLALGHIKGNYATRLSPTDP

SEQ ID NO: 817846 - protein, 113 aa, Homo sapiens; identical to SEQ ID NO: 817845

SEQ ID NO: 817847 - protein, 113 aa, Homo sapiens; identical to SEQ ID NO: 817845

SEQ ID NO: 817848 - protein, 113 aa, Homo sapiens; identical to SEQ ID NO: 817845

SEQ ID NO: 817849 - protein, 113 aa, Homo sapiens; identical to SEQ ID NO: 817845

SEQ ID NO: 817850 - protein, 113 aa, Homo sapiens
MDGLPGILYRFKIRMRTELFIACRGAFSHWASCVYCGQRRPSSTLAMRPSSTLANVLPCGHHCPEGTIVCCLEEKGYNSCACLGRRTPGRPVAKLALGHIKGNYATRLSPTDP

SEQ ID NO: 817851 - protein, 113 aa, Homo sapiens; identical to SEQ ID NO: 817850

SEQ ID NO: 817852 - protein, 90 aa, Homo sapiens
MDVWLALEVAELTARGGRKFDKKPNSLQRAWPGLLPHQNYTRAKRNCWPPKLRGAVGPLNSLLAAIPFSGKVGQTKPSTHFRAKPSQPIP

SEQ ID NO: 817853 - protein, 113 aa, Homo sapiens
MGGLPGILYRFKIRMRTELFIACRGAFSHWASCVYCGQRRPSSTLAMRPSSTLANVLPCGHHCPEGTIVCCLEEKGYNSCACLGRRTPGRPVAKLALGHIKGNYATRLSPTDP

SEQ ID NO: 817854 - protein, 81 aa, Homo sapiens
AALAALVKGPAQHWQMCSLVGTIALRVQSCAAWRRRGTIRVLALGGERLGDLWQSWPGGISGETMPPGYLPQTLETKEDPC

SEQ ID NO: 817855 - protein, 113 aa, Homo sapiens; identical to SEQ ID NO: 817845

SEQ ID NO: 817856 - protein, 73 aa, Homo sapiens
REQVYTASNYFRRPRVYVISHKTLRPRRPVLKALPSGLPKEGLSPFSQNRACGYGCLAGLGGGRIDSTWWPKI

SEQ ID NO: 817857 - protein, 102 aa, Homo sapiens
HASDPRRPRVRTHAVDPRVRGRVGAGEPGRPVAKLALGHIKGNYATRLSPTTLRPRRPVLKALPSGLPKEGLSPFSQNRACGYGCLAGLGGGRIDSTWWPKF

SEQ ID NO: 817858 - protein, 113 aa, Homo sapiens; identical to SEQ ID NO: 817850

SEQ ID NO: 817859 - protein, 143 aa, Homo sapiens
PRVADAWVDPRVRNKNADGAVHCLPRGIFTLGQLCVLRAKKAQLNIGNVLPCGHHCPEGTIVCCLEEKPGRPVAKLALGHIKGNYATRLSPTTLRPRRPVLKALPSGLPKEGLSPFSQNRACGYGCLAGLGGGRIDSTWWPKI

SEQ ID NO: 817860 - protein, 113 aa, Homo sapiens; identical to SEQ ID NO: 817850

SEQ ID NO: 817861 - protein, 117 aa, Homo sapiens
EEDRRHGELSDLMYKMNDPYVCSARAVQPVNTLSAYAAENFYDYYCYVKGIVSDVISQELGPARSPSYSGGSPAISRIGSKVDGAVIAARAFTGPVVYRLRRPSSTIGNVAPCGHHA

SEQ ID NO: 817862 - protein, 125 aa, Homo sapiens
MKAQLNIGNVLPVGTMPEGTTRVLALGGERLGDLWQSWPWGIFQKKGYLPSAKTELVDMDVWVALEVAELTARGGRKFDKKPNSLQRAWPGLLPHQNYTRAKRNCWPHEGTLLGPPESTGGCCAH

SEQ ID NO: 817863 - protein, 108 aa, Homo sapiens
MDVWVALEVAELTARGGRKFDKKPNSLQRAWPGLLPHQNYTRAKRNCWPRVRGVAMNPVEHPFGGGNHQHIRKPSTGFMATPRTTNLGKEELLATSTGCGHESCGASF

SEQ ID NO: 817864 - protein, 113 aa, Homo sapiens; identical to SEQ ID NO: 817845

SEQ ID NO: 817865 - protein, 113 aa, Homo sapiens; identical to SEQ ID NO: 817845

SEQ ID NO: 817866 - protein, 113 aa, Homo sapiens; identical to SEQ ID NO: 817845

SEQ ID NO: 817867 - protein, 113 aa, Homo sapiens; identical to SEQ ID NO: 817845

SEQ ID NO: 817868 - protein, 113 aa, Homo sapiens; identical to SEQ ID NO: 817845

SEQ ID NO: 817869 - protein, 113 aa, Homo sapiens; identical to SEQ ID NO: 817845

SEQ ID NO: 817870 - protein, 113 aa, Homo sapiens; identical to SEQ ID NO: 817845

SEQ ID NO: 817871 - protein, 113 aa, Homo sapiens; identical to SEQ ID NO: 817845

SEQ ID NO: 817872 - protein, 113 aa, Homo sapiens; identical to SEQ ID NO: 817845

SEQ ID NO: 817873 - protein, 113 aa, Homo sapiens; identical to SEQ ID NO: 817845

SEQ ID NO: 817874 - protein, 113 aa, Homo sapiens; identical to SEQ ID NO: 817845

SEQ ID NO: 817875 - protein, 113 aa, Homo sapiens; identical to SEQ ID NO: 817845

SEQ ID NO: 817876 - protein, 118 aa, Homo sapiens
MRQKISLAAAHKADATTFVEEKATKEKRDQPDTRRARTQREHEEETHGGMRNNNTARAHGTTTSNDEEKTECWSTAFCAAKAGRNSRRKTRRQTEQQQETISERRKQARPHQTPVRHR

SEQ ID NO: 817877 - protein, 113 aa, Homo sapiens; identical to SEQ ID NO: 817845

SEQ ID NO: 817878 - protein, 113 aa, Homo sapiens; identical to SEQ ID NO: 817845

SEQ ID NO: 817879 - protein, 113 aa, Homo sapiens; identical to SEQ ID NO: 817845

SEQ ID NO: 817880 - protein, 113 aa, Homo sapiens; identical to SEQ ID NO: 817845

SEQ ID NO: 817881 - protein, 113 aa, Homo sapiens; identical to SEQ ID NO: 817845

SEQ ID NO: 817882 - protein, 113 aa, Homo sapiens; identical to SEQ ID NO: 817845

SEQ ID NO: 817883 - protein, 113 aa, Homo sapiens; identical to SEQ ID NO: 817845

SEQ ID NO: 817884 - protein, 113 aa, Homo sapiens; identical to SEQ ID NO: 817845

SEQ ID NO: 817885 - protein, 113 aa, Homo sapiens; identical to SEQ ID NO: 817845

SEQ ID NO: 817886 - protein, 113 aa, Homo sapiens; identical to SEQ ID NO: 817845

SEQ ID NO: 817887 - protein, 113 aa, Homo sapiens; identical to SEQ ID NO: 817845

SEQ ID NO: 817888 - protein, 113 aa, Homo sapiens; identical to SEQ ID NO: 817845

SEQ ID NO: 817889 - protein, 286 aa, Homo sapiens
MTGGATRTPPRGPHPPPPPLPGQKGAPRGGPPHTKQRHTGAHTSKTAHQRGNHAKQGKPRTKHPTTRGSAPHKSGAQQNPTQESPLKRPQHGETPQRINTRAQTWLPPPQHRQKPSTPDQPTLGQIRGINIPPPGHHLLPPGAYTVNTPAEPNRRSNNTEQPTPCQARAAPHSPQNRMPHTTQQPKPQKEQRASLHPTAPGSQNRTNEQKRDRAEEGDDGRTGRDHRSGTERRQPPTDERHARHRGEKQQQRNRAERGWSRTSSRESKGAETDDNGRRMTTNAGCN

SEQ ID NO: 817890 - protein, 113 aa, Homo sapiens; identical to SEQ ID NO: 817845

SEQ ID NO: 817891 - protein, 113 aa, Homo sapiens; identical to SEQ ID NO: 817845

SEQ ID NO: 817892 - protein, 113 aa, Homo sapiens; identical to SEQ ID NO: 817845

SEQ ID NO: 817893 - protein, 114 aa, Homo sapiens
MAEIPTFLADKGAPKEGSESIKSTRRQRPGVNTVARGRKPLVTARHFGEEPPPTIRGGGTKYGGHNPPTHKDSTTPTGDIIKHFEPRLNRAYTHAVKSPPPENLRPRTTGSEHF

SEQ ID NO: 817894 - protein, 113 aa, Homo sapiens; identical to SEQ ID NO: 817845

SEQ ID NO: 817895 - protein, 113 aa, Homo sapiens; identical to SEQ ID NO: 817845

SEQ ID NO: 817896 - protein, 125 aa, Homo sapiens
MPKKNKKNNLGHQVPSLFGKSGGPLWTWPGAATRGRGGMTASGTLEHPCRGRTIAPKINGGATTERAPKELRNPCGESPSRETGSCPWEPSPGTRHLRSRQRYLPTFTRQHHTPTHNRHAEQGKP

SEQ ID NO: 817897 - protein, 113 aa, Homo sapiens; identical to SEQ ID NO: 817845

SEQ ID NO: 817898 - protein, 113 aa, Homo sapiens; identical to SEQ ID NO: 817845

SEQ ID NO: 817899 - protein, 113 aa, Homo sapiens; identical to SEQ ID NO: 817845

SEQ ID NO: 817900 - protein, 113 aa, Homo sapiens; identical to SEQ ID NO: 817845

SEQ ID NO: 817901 - protein, 60 aa, Homo sapiens
MPLLAAKWVSLLPAGLDVLPSDGNGAATSAVGTCIAGTCGIQRLRSLRCGEGQHRQHRAG

SEQ ID NO: 817902 - protein, 113 aa, Homo sapiens; identical to SEQ ID NO: 817845

SEQ ID NO: 817903 - protein, 113 aa, Homo sapiens; identical to SEQ ID NO: 817845

SEQ ID NO: 817904 - protein, 113 aa, Homo sapiens; identical to SEQ ID NO: 817845

SEQ ID NO: 817905 - protein, 165 aa, Homo sapiens
MPLLAAKWVSLLPAGLDVSGEPRLCRRKRTSAEGLNKVCVYAKKNKKNNLGHQVPSLFGKSGGPLWTWPGAATRGRGGMTASGTLEHPCRGRTIAPKINGGATTERAPKELRNPCGESPSRETGSCPWEPSPGTRHLRSRQRYLPTFTRQHHTPTHNRHAEQGKP

SEQ ID NO: 817906 - protein, 113 aa, Homo sapiens; identical to SEQ ID NO: 817845

SEQ ID NO: 817907 - protein, 113 aa, Homo sapiens; identical to SEQ ID NO: 817845

SEQ ID NO: 817908 - protein, 113 aa, Homo sapiens; identical to SEQ ID NO: 817845

SEQ ID NO: 817909 - protein, 113 aa, Homo sapiens; identical to SEQ ID NO: 817845

SEQ ID NO: 817910 - protein, 114 aa, Homo sapiens
MAEIPTFLADKGAPKEGSESIKSTRRQRPGENTVARGRKPLVTARHFGEEPPPTIRGGGTKVGGHNPPTHKDSTTPTGDIIKHFEPRLNRAYTHAVKSPPPENLRPRTTGSEHF

SEQ ID NO: 817911 - protein, 113 aa, Homo sapiens; identical to SEQ ID NO: 817845

SEQ ID NO: 817912 - protein, 151 aa, Homo sapiens
MVGLPGILYRFKIRMRTELFIACRGAFSHWASCVYCGQRRPSSTLAMRPSSTLANVLPCGHHCPEGTIVCCLEEKGYNSCACLGRRTPGRPVAKLALGHKTLRPRRPVLKALPSGLPKEGLSPFSQNRACGYGCLAGLGGGRIDSTWWPQF

SEQ ID NO: 817913 - protein, 150 aa, Homo sapiens
MVGLPGILYRFKIRMRTELFIACRGAFSHWASCVYCGQRRPSSTLAMRPSSTLANVLPCGHHCPEGTIVCCLEEKPGRPVAKLALGHIKGNYATRLSPTTLRPRRPVLKALPSGLPKEGLSPFSQNRACGYGCLAGLGGGRIDSTWWPKI

SEQ ID NO: 817914 - protein, 221 aa, Homo sapiens
MPKKKTTQTPPHTPTHTHPPNHTHTTNNRGAANNISSRARQQLPANPPPSRIDQARPPQQREPSHTQPTPARRHTPPPPTQPHNRATGHPTSNTPPTRVRRHNLRDETTTPLSPPATTHPRRYSSAPHHLLAAATTPPRPLSPHLPPDLPLTPPPHSPPPSRPRPPALPPSRRRLRIHAPHLTSSTPAHRRLDLLTLPTTHPLHSARPYYPRTRRSLPRTT

SEQ ID NO: 817915 - protein, 194 aa, Homo sapiens
MVGLPGILYRFKIRMRTELFIACRGAFSHWASCVYCGQRRPSSTLAMRPSSTLANVLPCGHHCPEGTIVCCLEEKGYNSCACLGRRTPGRPVAKLALGHIKGNYATRLSPTFQKKGYLPSAKTELVDMDVWVALEVAELTARGGRKFDKKPNSLQRAWPGLLPHQNYTRAKRNCWPHEGTLLGPPESTGGCCAH

SEQ ID NO: 817916 - protein, 194 aa, Homo sapiens; identical to SEQ ID NO: 817915

SEQ ID NO: 817917 - protein, 184 aa, Homo sapiens
MVGLPGILYRFKIRMRTELFIACRGAFSHWASCVYCGQRRPSSTLAMRPSSTLANVLPCGHHCPEGTIVCCLEEKGYNSCACLGRRTPGRPVAKLALGHIKGNYATRLSPTNSLVGKQFLFFWQEVGNPAKANNIRGQSPSHQIPAEDLPPLSWGRKKWGLILACPAGTWEPSPGNQDCAEKEN

SEQ ID NO: 817918 - protein, 162 aa, Homo sapiens
MVGLPGILYRFKIRMRTELFIACRGAFSHWASCVYCGQRRPSSTLAMRPSSTLANVLPCGHHCPEGTIVCCLEEKGYNSCACLGRRTPGRPVAKLALGHIKGNYATRLSPTTLRPRRPVLKALPSGLPKEGLSPFSQNRACGYGCLAGLGGGRIDSTWWPKI

SEQ ID NO: 817919 - protein, 173 aa, Homo sapiens
MVGLPGILYRFKIRMRTELFIACRGAFSHWASCVYCGQRRPSSTLAMRPSSTLANVLPCGHHCPEGTIVCCLEEKGYNSCACLGRRTPGRPVAKLALGHIKGNYATRLSPTTLRPRRPVLKALPSGLPKEGLSPFSQNRACGYGCLAGLGGGRIDKPILKRWSAADLGILFES

SEQ ID NO: 817920 - protein, 153 aa, Homo sapiens
MVGLPGILYRFKIRMRTELFIACRGAFSHWASCVYCGQRRPSSTLAMRPSSTLANVLPCGHHCPEGTIVCCLEEKGYNSCACLGRRTPGRPVAKLALGHARGGRKFDKKPNSLQRAWPGLLPHQNYTRAKRNCWPHEGTLLGPPESTGGCCAH

SEQ ID NO: 817921 - protein, 118 aa, Homo sapiens
SLQRAWPGLLPHQNYTRAKRNCWPRVRGVAMNVSNPEMQGWVLKLQWPHCWVGKSHPQVSLQEGDLRWEEQQVVVCSHGTVDPAPALLKEVGSPSFTVSPQETEAGRGSGGLSWKESA

SEQ ID NO: 817922 - protein, 358 aa, Homo sapiens
RNQERLNPRDVEYGTIEGLITTNVGDSTLADLLDHSCTSGSGSGLPFLVQRTVARQITLLECVGKGRYGEVWRGSWQGENVAVKIFSSRDEKSWFRETELYNTVMLRHENILGFIASDMTSRHSSTQLWLITHYHEMGSLYDYLQLTTLDTVSCLRIVLSIASGLAHLHIEIFGTQGKPAIAHRDLKSKNILVKKNGQCCIADLGLAVMHSQSTNQLDVGNNPRVGTKRYMAPEVLDETIQVDCFDSYKRVDIWAFGLVLWEVARRMVSNGIVEDYKPPFYDVVPNDPSFEDMRKVVCVDQQRPNIPNRWFSDPTLTSLAKLMKECWYQNPSARLTALRIKKTLTKIDNSLDKLKTDC

SEQ ID NO: 817923 - protein, 358 aa, Homo sapiens; identical to SEQ ID NO: 817922

SEQ ID NO: 817924 - protein, 358 aa, Homo sapiens; identical to SEQ ID NO: 817922

SEQ ID NO: 817925 - protein, 180 aa, Homo sapiens
MGQQISDQTQLVINKLPEKVAKHVTLVRESGSLTYEEFLGRVAELNDVTAKVASGQEKHLLFEVQPGSDSSAFWKVVVRVVCTKINKSSGIVEASRIMNLYQFIQLYKDITSQAAGVLAQSSTSEEPDENSSSVTSCQASLWMGRVKQLTDEEECCICMDGRADLILPCAHSFCQKCIDK

SEQ ID NO: 817926 - protein, 230 aa, Homo sapiens
MGQQISDQTQLVINKLPEKVAKHVTLVRESGSLTYEEFLGRVAELNDVTAKVASGQEKHLLFEVQPGSDSSAFWKVVVRVVCTKINKSSGIVEASRIMNLYQFIQLYKDITSQAAGVLAQSSTSEEPDENSSSVTSCQASLWMGRVKQLTDEEECCICMDGRADLILPCAHSFCQKCIDKWSDRHRNCPICRLQMTGANESWVVSDAPTEDDMANYILNMADEAGQPHRP

SEQ ID NO: 817927 - protein, 181 aa, Homo sapiens
MGQQISDQTQLVINKLPEKVAKHVTLVRESGSLTYEEFLGRVAELNDVTAKVASGQEKHLLFEVQPGSDSSAFWKVVVRVVCTKINKSSGIVEASRIMNLYQFIQLYKDITSQAAGVLAQSSTSEEPDENSSSVTSCQASLWMGRVKQLTDEEECCICMDGRADLILPCAHSFCQKCIDKW

SEQ ID NO: 817928 - protein, 166 aa, Homo sapiens
MGQQISDQTQLVINKLPEKVAKHVTLVRESGSLTYEEFLGRVAELNDVTAKVASGQEKHLLFEVQPGSDSSAFWKVVVRVVCTKINKSSGIVEASRIMNLYQFIQLYKDITSQAAGVLPHHLTSFILVNPILRHRPSGLFLGGKGPPPDPEGVSLFWSLVQLHQKN

SEQ ID NO: 817929 - protein, 230 aa, Homo sapiens; identical to SEQ ID NO: 817926

SEQ ID NO: 817930 - protein, 230 aa, Homo sapiens; identical to SEQ ID NO: 817926

SEQ ID NO: 817931 - protein, 230 aa, Homo sapiens; identical to SEQ ID NO: 817926

SEQ ID NO: 817932 - protein, 230 aa, Homo sapiens; identical to SEQ ID NO: 817926

SEQ ID NO: 817933 - protein, 231 aa, Homo sapiens
MGQNWHFRRAVISENCRIKPIQDEAWQLENRAGNWQRLNYFHRRLCFLRTAKVASGQEKHLLFEVQPGSDSSAFWKVVVRVVCTKINKSSGIVEASRIMNLYQFIQLYKDITSQAAGVLAQSSTSEEPDENSSSVTSCQASLWMGRVKQLTDEEECCICMDGRADLILPCAHSFCQKCIDKWSDRHRNCPICRLQMTGANESWVVSDAPTEDDMANYILNMADEAGQPHRP

SEQ ID NO: 817934 - protein, 87 aa, Homo sapiens
AGLVGKVVYGHTCFLERILVNDYSLCHIRRIHMNAPSIDCSFCHRDPYGNCWSITRILLTRSVSQRLLDYQLIALRALDLLSLIQIT

SEQ ID NO: 817935 - protein, 157 aa, Homo sapiens
MGQQISDQTQLVINKLPEKVAKHVTLVRESGSLTYEEFLGRVAELNDVTAKVASGQEKHLLFEVQPGSDSSAFWKVVVRVVCTKINKSSGIVEASRIMNLYQFIQLYKDITSQAAGVLAQSSTSEEPDENSSSVTSCQASLWMGRYIMHKYCISLIF

SEQ ID NO: 817936 - protein, 369 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 817937 - protein, 384 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 817938 - protein, 369 aa, Homo sapiens; identical to SEQ ID NO: 817936

SEQ ID NO: 817939 - protein, 377 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGTYLTDETHREVKFTSL

SEQ ID NO: 817940 - protein, 399 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 817941 - protein, 362 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIVVGVAVICVVPYRYLQRRKKKGTYLTDETHREVKFTSL

SEQ ID NO: 817942 - protein, 369 aa, Homo sapiens
MVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGPRPTYKPPVSNYPGYPKPEEGILDSLDVWVIAVIVIAIVVGVAVICVVPYRYLQRRKKKGTYLTDETHREVKFTSL

SEQ ID NO: 817943 - protein, 324 aa, Homo sapiens [sequence omitted]

SEQ ID NO: 817944 - protein, 369 aa, Homo sapiens; identical to SEQ ID NO: 817936

SEQ ID NO: 817945 - protein, 324 aa, Homo sapiens [sequence omitted]

SEQ ID NO: 817946 - protein, 349 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIGKQMVELNMPLTRLNQPLQQSREAE

SEQ ID NO: 817947 - protein, 136 aa, Homo sapiens
AVRKVLRYSHAERVTNIYTDTHEEQGHAHLSCSTGCFVSWGLLRPISGPRRDFPARLALGFSAFLRRNNSVFRAAHGASRPPRVSLSFLALSWVASGGHGVAAVLLLRPASASHSAGITGVSHHTHPHITFMMVIF

SEQ ID NO: 817948 - protein, 369 aa, Homo sapiens; identical to SEQ ID NO: 817936

SEQ ID NO: 817949 - protein, 369 aa, Homo sapiens; identical to SEQ ID NO: 817936

SEQ ID NO: 817950 - protein, 369 aa, Homo sapiens; identical to SEQ ID NO: 817936

SEQ ID NO: 817951 - protein, 369 aa, Homo sapiens; identical to SEQ ID NO: 817936

SEQ ID NO: 817952 - protein, 369 aa, Homo sapiens; identical to SEQ ID NO: 817936

SEQ ID NO: 817953 - protein, 369 aa, Homo sapiens; identical to SEQ ID NO: 817936

SEQ ID NO: 817954 - protein, 369 aa, Homo sapiens; identical to SEQ ID NO: 817936

SEQ ID NO: 817955 - protein, 324 aa, Homo sapiens [sequence omitted]

SEQ ID NO: 817956 - protein, 369 aa, Homo sapiens; identical to SEQ ID NO: 817936

SEQ ID NO: 817957 - protein, 324 aa, Homo sapiens [sequence omitted]

SEQ ID NO: 817958 - protein, 302 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPDIL

SEQ ID NO: 817959 - protein, 235 aa, Homo sapiens [sequence omitted]

SEQ ID NO: 817960 - protein, 160 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICERI

SEQ ID NO: 817961 - protein, 138 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIVRGN

SEQ ID NO: 817962 - protein, 142 aa, Homo sapiens
AVRKVLRYSHAERVTNIYTDTHEAGPRPPVLQHWMLYACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIVRGN

SEQ ID NO: 817963 - protein, 214 aa, Homo sapiens
MQLKQSTCERVMILRSRFLDARRKRRNFNKQATEILNEEVRSIIMLQEKAQDRERLLLKFIKIMKHLRKLNNFNSYLAILSALDSAPIRRLEWQKQTSEGLAEYCTLIDSSSSFRAYREKLTEDEVERVITIMQNPRQYKIPDWFLNRQKDVKDGKYSQVLANGLDNKLREDLERLKKIRAHRGLRHFWGLRVRGQHTKTTGRRGRTVGVSKKK

SEQ ID NO: 817964 - protein, 1077 aa, Homo sapiens
MDTDSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 817965 - protein, 1077 aa, Homo sapiens; identical to SEQ ID NO: 817964

SEQ ID NO: 817966 - protein, 1077 aa, Homo sapiens; identical to SEQ ID NO: 817964

SEQ ID NO: 817967 - protein, 1095 aa, Homo sapiens
MGNAIEKQKPLKRSHLYPWKQDSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 817968 - protein, 1077 aa, Homo sapiens; identical to SEQ ID NO: 817964

SEQ ID NO: 817969 - protein, 1132 aa, Homo sapiens
AAARSPPCRRGSEAWRARAEASGGRAAPVAPRRPGPGPMSGGLGLRRSPEMSGKIEKADSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 817970 - protein, 1094 aa, Homo sapiens
AAARSPPCRRGSEAWRARAEASGGRAAPVAPRRPGPGPMSGGLGLRRSPEMSGKIEKADSQRSHLSSFTMKLMDKFHSPKIKRTPSKKGKPAEVSVKIPEKPVNKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 817971 - protein, 828 aa, Homo sapiens [sequence omitted]

SEQ ID NO: 817972 - protein, 539 aa, Homo sapiens
APDPPRTSGRSSPSCLSVSLDIISLWSMRDSSLTSFSSVSHCVQQTKVAFTPEDGSAAQGLSVSVSNSFLSRHGSLPVPSEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 817973 - protein, 1077 aa, Homo sapiens; identical to SEQ ID NO: 817964

SEQ ID NO: 817974 - protein, 1095 aa, Homo sapiens; identical to SEQ ID NO: 817967

SEQ ID NO: 817975 - protein, 476 aa, Homo sapiens
GTRVGLSSHSTVLQAAPSSVESAHEIKPFPVSPLLSAVSFERWTERTCDFSGTCRRRHQRGFPSPRLPRPSHSPCHLPCLSQSKDSNPPWLPPPSTLHPDKQFALFFPLDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 817976 - protein, 401 aa, Homo sapiens
MAQCSPASPTKLSWLLAMMHPQRPVDLGPFFQKPDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 817977 - protein, 296 aa, Homo sapiens
AIYSMAVKVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 817978 - protein, 795 aa, Homo sapiens
MGNAIEKQKPLKRSHLYPWKQDSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYPFLPDPGPLHHGHFGERGTLLPFSPRGGSRAAYWVAV

SEQ ID NO: 817979 - protein, 105 aa, Homo sapiens
ASPRWKATCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 817980 - protein, 171 aa, Homo sapiens [sequence omitted]

SEQ ID NO: 817981 - protein, 795 aa, Homo sapiens; identical to SEQ ID NO: 817978

SEQ ID NO: 817982 - protein, 1095 aa, Homo sapiens; identical to SEQ ID NO: 817967

SEQ ID NO: 817983 - protein, 1060 aa, Homo sapiens
MGNAIEKQKPLKRSHLYPWKQDSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYTYLSLGFYFDRDDVALEGVSHFFRELAEEKREGYERLLKM

SEQ ID NO: 817984 - protein, 848 aa, Homo sapiens
MGNAIEKQKPLKRSHLYPWKQDSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLKSMEAEMIQLQEELAPRSSAKQQAQQERDELADEIAISSGKVPGGREEE

SEQ ID NO: 817985 - protein, 768 aa, Homo sapiens
MGNAIEKQKPLKRSHLYPWKQDSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEVRTSRAGALQPGPTEESRWGREECDLVISRTTLGGLETKSFNAPGEPLGCGLWRGRLQGKCAVSF

SEQ ID NO: 817986 - protein, 37 aa, Homo sapiens
MRRNDDIINFFNDFSDHLAEEALWELSLKIKPRNITR

SEQ ID NO: 817987 - protein, 1010 aa, Homo sapiens
ASPQERERRGGRSRRRAPPWARTRPRQLPGRLGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGPRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 817988 - protein, 89 aa, Homo sapiens
LWVGLPCGRQHFHFSPSVGSDGAGRSGTYVLIDMVLNKMAKGAKEIDIAATLEHLRDQRPGMVQTKEQFEFALTAVAEEVNAILKALPQ

SEQ ID NO: 817989 - protein, 135 aa, Homo sapiens
VRIAAPRSARGERPRVPAHCGGAAGRRPGVPSGPLRSETRGLRDKRQFRLPRVQVCSSTAAGLGRRFWHVPGRPVSGEGPCVWETEAAGSAGEPGKERGGLLPREEAQAGLALRLSEEPALPASEDAPRTLLSWA

SEQ ID NO: 817990 - protein, 143 aa, Homo sapiens
GVAAGAREARREEPAARASLGPDSAASRRLPRGHGLSAAGQAAGMGPPLPLLLLLLLLLPPRVLPAAPSSVPRGRQLPGRLGCLLEEGLCGASEACVNGGAESHKGTWNPAEWARAACHGPSCPEHLLRGGGGVTLIPSWTPQ

SEQ ID NO: 817991 - protein, 133 aa, Homo sapiens
APSSVRVPASAAPACPFSLLPFIVFSLKAERSQSPHGGPLAIPTAPSALHCLSCCWKLSPLRPEEGRRLVEDVARLLQVPSSAFADVDSIQTTQRVRKNLHDLYIRQKTNIQTLQRTHISKKQTVPSNNGLKT

SEQ ID NO: 817992 - protein, 1059 aa, Homo sapiens
GVAAGAREARREEPAARASLGPDSAASRRLPRGHGLSAAGQAAGMGPPLPLLLLLLLLLPPRVLPAAPSSVPRGRQLPGRLGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGPRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 817993 - protein, 1042 aa, Homo sapiens
GVAAGAREARREEPAARASLGPDSAASRRLPRGHGLSAAGQAAGMGPPLPLLLLLLLLLPPRVLPAAPSSVPRGRQLPGRLDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGPRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 817994 - protein, 1030 aa, Homo sapiens
GVAAGAREARREEPAARASLGPDSAASRRLPRGHGLSAAGQAAGMGPPLPLLLLLLLLLPPRVLPAAPSSVPRGRQLPGRLGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGPRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDREVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 817995 - protein, 1021 aa, Homo sapiens
GVAAGAREARREEPAARASLGPDSAASRRLPRGHGLSAAGQAAGMGPPLPLLLLLLLLLPPRVLPAAPSSVPRGRQLPGRLGCLLEEGLCGASEACVNGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGPRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 817996 - protein, 680 aa, Homo sapiens
MAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 817997 - protein, 649 aa, Homo sapiens
GTPESPLLNTGRLGCSDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 817998 - protein, 485 aa, Homo sapiens
VRIAAPRSARGERPRVPAHCGGAAGRRPGVPSGPLRSETRGLRDKRQFRLPRVQVCSSTAAGLGRRFWHVPGRPVSGEGPCVWETEAAGSAGEPGKERGGLLPREEAQAGLALRLSEEPALPASEDAPRTLLSWAWGDTFCLIEAPRFAEVSGRSRGRRNTLRLRDVGPARTRLRPCLPAAVSARTIGRDRNCWFCVCEKSSTGNKSPAELTAETKDKRSRLAPSLLSPENGLVSALDLFADRFRSWRNHRDDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 817999 - protein, 1006 aa, Homo sapiens
GVAAGAREARREEPAARASLGPDSAASRRLPRGHGLSAAGQAAGMGPPLPLLLLLLLLLPPRVLPAAPSSVPRGRQLPGRLGCLLEEGLCGASEACVNGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGPRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLGERHPQGPSPGADTCAPHE

SEQ ID NO: 818000 - protein, 89 aa, Homo sapiens; identical to SEQ ID NO: 817988

SEQ ID NO: 818001 - protein, 151 aa, Homo sapiens
NSDTVKRFSSFCSGKIYHIFGQRGGNKQEGVTSEHSSSSHKLQAAQRLEAPRGLPSPLTWILPARVLPPPLTSAILSSRRPPDGAGRSGTYVLIDMVLNKMAKGAKEIDIAATLEHLRDQRPGMVQTKEQFEFALTAVAEEVNAILKALPQ

SEQ ID NO: 818002 - protein, 1030 aa, Homo sapiens; identical to SEQ ID NO: 817994

SEQ ID NO: 818003 - protein, 993 aa, Homo sapiens
GVAAGAREARREEPAARASLGPDSAASRRLPRGHGLSAAGQAAGMGPPLPLLLLLLLLLPPRVLPAAPSSVPRGRQLPGRLGCLLEEGLCGASEACVNGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGPRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLSSLSSR

SEQ ID NO: 818004 - protein, 1030 aa, Homo sapiens; identical to SEQ ID NO: 817994

SEQ ID NO: 818005 - protein, 1059 aa, Homo sapiens; identical to SEQ ID NO: 817992

SEQ ID NO: 818006 - protein, 854 aa, Homo sapiens
GVAAGAREARREEPAARASLGPDSAASRRLPRGHGLSAAGQAAGMGPPLPLLLLLLLLLPPRVLPAAPSSVPRGRQLPGRLGCLLEEGLCGASEACVNGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGPRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQVNIFKLKSLFLKRRSQ

SEQ ID NO: 818007 - protein, 155 aa, Homo sapiens
FVLAKFTTSLAKEGGTSKRESHLSTAAHPTSYKLLRGSKPPGASLLPSLGFSQPASFLPLSHPPSFPLAGPRKQEGNELSLALLWVGLPCGRQHFHFSPSVGSDGAGRSGTYVLIDMVLNKMAKGETQTLPLCCGSELGWRRYGNVGCRVHGRPW

SEQ ID NO: 818008 - protein, 107 aa, Homo sapiens
MATRPPDRPEGPHTSRISSVSSQFSDGPIPSPSARSSASSWSEEPVQSNMDISTGHMILVSPVFALPATQTPGPSFLGPCNTQHLRPLTLGDWAMMAAPCPLQRLTG

SEQ ID NO: 818009 - protein, 574 aa, Homo sapiens
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMARARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRGLPDLVPDPNYVQASTYVQRAHLYSLRCAAEEKCLASTAYAPEATDYDVRVLLRFPQRVKNQGTADFLPNRPRHTWEWHSCHQHYHSMDEFSHYDLLDAATGKKVAEGHKASFCLEDSTCDFGNLKRYACTSHTQGLSPGCYDTYNADIDCQWIDITDVQPGNYILKVHVNPKYIVLESDFTNNVVRCNIHYTGRYVSATNCKIVQS

SEQ ID NO: 818010 - protein, 396 aa, Homo sapiens
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMARARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRVTPAQTPACPGRKVEGQEQDGQAPGSGTS

SEQ ID NO: 818011 - protein, 223 aa, Homo sapiens
FFCCFDLKTTHFIISSFCGSGIQVWFSQVFWLKVSYKGKSKGSAKALVSSEGSTGEGFASKFPHMAAGSMWFLTSCWTVGLSSWLAVGQPPPSVLCHMGFPYRWLTTQQLPIPTSGLTFPPLSETGNLTAGPGSRSSPEGDKVLTGEGPTAPEQRGYLAEWGTKSSPPLHPGRQELLPVRSSDTPPPGGERNGAQQGRLSVGSVYRPNQNGRGEYGPGAPPAA

SEQ ID NO: 818012 - protein, 276 aa, Homo sapiens
MGNPVSPLRNREGILRSGGQSLDLLFIQAEQELLPVRSSDTPPPGGERNGAQQGRLSVGSVYRPNQNGRGLPDLVPDPNYVQASTYVQRAHLYSLRCAAEEKCLASTAYAPEATDYDVRVLLRFPQRVKNQGTADFLPNRPRHTWEWHSCHQHYHSMDEFSHYDLLDAATGKKVAEGHKASFCLEDSTCDFGNLKRYACTSHTQGLSPGCYDTYNADIDCQWIDITDVQPGNYILKVHVNPKYIVLESDFTNNVVRCNIHYTGRYVSATNCKIVQS

SEQ ID NO: 818013 - protein, 609 aa, Homo sapiens
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMARARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRGLPDLVPDPNYVQASTYVQRAHLYSLRCAAEEKCLASTAYAPEATDYDVRVLLRFPQRVKNQGTADFLPNRPRHTWEWHSCHQHYHSMDEFSHYDLLDAATGKKVAEGHKASFCLEDSTCDFGNLKRYACTSHTQGLSPGCYDTYNADIDCQWIDITDVQPGNYILKVHVNPKYIVLESDFTNNVVRCNIHYTGRYVSATNCKIVQQAAGPACTGSWTERSQKGHGTDACGFPSCFWRKKEA

SEQ ID NO: 818014 - protein, 574 aa, Homo sapiens; identical to SEQ ID NO: 818009

SEQ ID NO: 818015 - protein, 425 aa, Homo sapiens
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMARARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEATGRRARWSRPTCRCAAPTRPRRVGSGTARSRAASAWAACTGPTRTAAVSLTWSQTPTMCKHPLMCREPTCTPCAVLRRRSVWPAQPMPLRPPTTMCGCYCASPSA

SEQ ID NO: 818016 - protein, 110 aa, Homo sapiens
QGQGRNPGEGGPETPEGGRGVALGNKQHHSRFLLSLSQGLSPGCYDTYNADIDCQWIDITDVQPGNYILKVHVNPKYIVLESDFTNNVVRCNIHYTGRYVSATNCKIVQS

SEQ ID NO: 818017 - protein, 146 aa, Homo sapiens
KIVHSIVSSFAVGIFGVFLILLDVALIFADLIFTDSKVYIPLEYHSISLAIALFFLMDVLLRVFVEGRQHYFSDLLNILDTAVTVIILLVDVVYIFFDVKFLKDIPRWTRLFRLLRLIILIRVFHLAHLKRQLGKLIRRLVSGNKR

SEQ ID NO: 818018 - protein, 132 aa, Homo sapiens
RPETEESAGDVFGMGTHCYSCAPGWLCVSAVLVESRCFYLLAPFPATLCPVEARRHQRLQFCYSLLGMERSGTAVQRSWPRRSSGIPVPRAVHSVILRLPGVEGITCWVLESIALHLRKEKSQKDKMTCPRS

SEQ ID NO: 818019 - protein, 97 aa, Homo sapiens
RPETEESAGDVFGMGTHCYSCAPGWLCVSAVLVESRCFYLLAPFPATLCPVEARRHQRLQFCYSLLGMERSGQKIISKDILALTALSVARKLSSVNC

SEQ ID NO: 818020 - protein, 88 aa, Homo sapiens
PPALLLPCSLISDCCASNQRDSVGVGPSKPGERAYDPKHFHNRVSRIMIDDHNVPTLREMVAFSKEVLEWMAQDSENIVVIHCKGGKE

SEQ ID NO: 818021 - protein, 97 aa, Homo sapiens; identical to SEQ ID NO: 818019

SEQ ID NO: 818022 - protein, 97 aa, Homo sapiens; identical to SEQ ID NO: 818019

SEQ ID NO: 818023 - protein, 593 aa, Homo sapiens
VSTPTESGVPSAEEVFGSSQPERISPESGLAKAMLTIAITATPSLTVDEKEELLTSTNFQPIVEEITETTKGFLKYMDNQSFATESQEGVGLGHSPSSYVNTKEMLTTNPKTEKFEADTDHRTTSFPGAESTAGSEPGSLTPDKEKPSQMTADNTQAAATKQPLETSEYTLSVEPETDSLLGAPEVTVSVSTAVPAASALSDEWDDTKLESVSRIRTPKLGDNEETQVRTEMSQTAQVSHEGMEGGQPWTEAAQVALGLPEGETHTGTALLIAHGNERSPAFTDQSSFTPTSLMEDMKVSIVNLLQSTGDFTESTKENDALFFLETTVSVSVYESEADQLLGNTMKDIITQEMTTAVQEPDATLSMVTQEQVATLELIRDSGKTEEEKEDPSPVSDVPGVTQLSRRWEPLATTISTTVVPLSFEVTPTVEEQMDTVTGPNEEFTPVLGSPVTPPGIMVGEPSISPALPALEASSERRTVVPSITRVNTAASYGLDQLESEEGQEDEDEEDEEDEDEEEEDEEEDEEDKDADSLDEGLDGDTELPGFTLPGITSQEPGLEEGNMDLLEGATYQVPDALEWEQQNQGLGKSHVYF

SEQ ID NO: 818024 - protein, 664 aa, Homo sapiens
VSTPTESGVPSAEEVFGSSQPERISPESGLAKAMLTIAITATPSLTVDEKEELLTSTNFQPIVEEITETTKGFLKYMDNQSFATESQEGVGLGHSPSSYVNTKEMLTTNPKTEKFEADTDHRTTSFPGAESTAGSEPGSLTPDKEKPSQMTADNTQAAATKQPLETSEYTLSVEPETDSLLGAPEVTVSVSTAVPAASALSDEWDDTKLESVSRIRTPKLGDNEETQVRTEMSQTAQVSHEGMEGGQPWTEAAQVALGLPEGETHTGTALLIAHGNERSPAFTDQSSFTPTSLMEDMKVSIVNLLQSTGDFTESTKENDALFFLETTVSVSVYESEADQLLGNTMKDIITQEMTTAVQEPDATLSMVTQEQVATLELIRDSGKTEEEKEDPSPVSDVPGVTQLSRRWEPLATTISTTVVPLSFEVTPTVEEQMDTVTGPNEEFTPVLGSPVTPPGIMVGEPSISPALPALEASSERRTVVPSITRVNTAASYGLDQLESEEGQEDEDEEDEEDEDEEEEDEEEDEEDKDADSLDEGLDGDTELPGFTLPGITSQEPGLEEGNMDLLEGATYQVPDALEWEQQNQGLVRSWMEKLKDKAGYMSGMLVPVGVGIAGALFILGALYSIKVMNRRRRNGFKRHKRKQREFNSMQDRVMLLADSSEDEF

SEQ ID NO: 818025 - protein, 513 aa, Homo sapiens
VSTPTESGVPSAEEVFGSSQPERISPESGLAKAMLTIAITATPSLTVDEKEELLTSTNFQPIVEEITETTKGFLKYMDNQSFATESQEGVGLGHSPSSYVNTKEMLTTNPKTEKFEADTDHRTTSFPGAESTAGSEPGSLTPDKEKPSQMTADNTQAAATKQPLETSEYTLSVEPETDSLLGAPEVTVSVSTAVPAASALSDEWDDTKLESVSRIRTPKLGDNEETQVRTEMSQTAQVSHEGMEGGQPWTEAAQVALGLPEGETHTGTALLIAHGNERSPAFTDQSSFTPTSLMEDMKVSIVNLLQSTGDFTESTKENDALFFLETTVSVSVYESEADQLLGNTMKDIITQEMTTAVQEPDATLSMVTQEQVATLELIRDSGKTEEEKEDPSPVSDVPGVTQLSRRWEPLATTISTTVVPLSFEVTPTVEEQMDTVTGPNEEFTPVLGSPVTPPGIMVGEPSISPALPALEASSERRTVVPSITRVNTAASYGLDQLESEGIHALKGIFSRTG

SEQ ID NO: 818026 - protein, 112 aa, Homo sapiens
MAAALARLGLRPVKQVRVQFCPFEKNVESTRTFLQTVSSEKVRSTNLNCSVIADVRHDGSEPCVDVLFGDGHRLIMRGAHLTALEMLTAFASHIRARDAAGSGDKPGADTGR

SEQ ID NO: 818027 - protein, 112 aa, Homo sapiens; identical to SEQ ID NO: 818026

SEQ ID NO: 818028 - protein, 112 aa, Homo sapiens; identical to SEQ ID NO: 818026

SEQ ID NO: 818029 - protein, 523 aa, Homo sapiens
QDIRLDFQTHCPGEERSGPRTPACPGLASCTCCPLTPGKMAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSASGPTRLVLSDCATSHGSLRIQLLHKLSFLVNALAKQVMNLLVPSLPNLVKNQLCPVIEASFNGMYADLLQLVKVPISLSIDRLEFDLLYPAIKGDTIQLYLGAKLLDSQGKVTKWFNNSAASLTMPTLDNIPFSLIVSQDVVKAAVAAVLSPEEFMVLLDSVLPESAHRLKSSIGLINEKAADKLGSTQIVKILTQDTPEFFIDQGHAKVAQLIVLEVFPSSEALRPLFTLGIEASSEAQFYTKGDQLILNLNNISSDRIQLMNSGIGWFQPDVLKNIITEIIHSILLPNQNGKLRSGVPVSLVKALGFEAAESSLTKDALVLTPASLWKPTSPVSQ

SEQ ID NO: 818030 - protein, 217 aa, Homo sapiens
QDIRLDFQTHCPGEERSGPRTPACPGLASCTCCPLTPGKMAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSASGPTRLVLSDCATSHGTWHQCDKLLGRLLQV

SEQ ID NO: 818031 - protein, 523 aa, Homo sapiens; identical to SEQ ID NO: 818029

SEQ ID NO: 818032 - protein, 516 aa, Homo sapiens
QDIRLDFQTHCPGEERSGPRTPACPGLASCTCCPLTPGKMAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSASGPTRLVLSDCATSHGSLRIQLLHKLSFLVNALAKQVMNLLVPSLPNLVKNQLCPVIEASFNGMYADLLQLVKVPISLSIDRLEFDLLYPAIKGDTIQLYLGAKLLDSQGKVTKWFNNSAASLTMPTLDNIPFSLIVSQDVVKAAVAAVLSPEEFMVLLDSVLPESAHRLKSSIGLINEKAADKLGSTQIVKILTQDTPEFFIDQGHAKVAQLIVLEVFPSSEALRPLFTLGIEASSEAQFYTKGDQLILNLNNISSDRIQLMNSGIGWFQPDVLKNIITEIIHSILLPNQNGKLRSGVPVSLVKALGFEAAESSLTKASHASECLRPPK

SEQ ID NO: 818033 - protein, 476 aa, Homo sapiens
QDIRLDFQTHCPGEERSGPRTPACPGLASCTCCPLTPGKMAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSASGPTRLVLSDCATSHGSLRIQLLHKLSFLVNALAKQVMNLLVPSLPNLVKNQLCPVIEASFNGMYADLLQLVKVPISLSIDRLEFDLLYPAIKGDTIQLYLGAKLLDSQGKVTKWFNNSAASLTMPTLDNIPFSLIVSQDVVKAAVAAVLSPEEFMVLLDSVLPESAHRLKSSIGLINEKAADKLGSTQIVKILTQDTPEFFIDQGHAKVAQLIVLEVFPSSEALRPLFTLGIEASSEAQFYTKGDQLILNLNNISSDRIQLMNSGIGWFQPDVLKASSRRLTRRLTSWA

SEQ ID NO: 818034 - protein, 213 aa, Homo sapiens
MPTLDNIPFSLIVSQDVVKAAVAAVLSPEEFMVLLDSVLPESAHRLKSSIGLINEKAADKLGSTQIVKILTQDTPEFFIDQGHAKVAQLIVLEVFPSSEALRPLFTLGIEASSEAQFYTKGDQLILNLNNISSDRIQLMNSGIGWFQPDVLKNIITEIIHSILLPNQNGKLRSGVPVSLVKALGFEAAESSLTKDALVLTPASLWKPTSPVSQ

SEQ ID NO: 818035 - protein, 484 aa, Homo sapiens [sequence omitted]

SEQ ID NO: 818036 - protein, 494 aa, Homo sapiens
QDIRLDFQTHCPGEERSGPRTPACPGLASCTCCPLTPGKMAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTRLVLSDCATSHGSLRIQLLHKLSFLVNALAKQVMNLLVPSLPNLVKNQLCPVIEASFNGMYADLLQLVKVPISLSIDRLEFDLLYPAIKGDTIQLYLGAKLLDSQGKVTKWFNNSAASLTMPTLDNIPFSLIVSQDVVKAAVAAVLSPEEFMVLLDSVLPESAHRLKSSIGLINEKAADKLGSTQIVKILTQDTPEFFIDQGHAKVAQLIVLEVFPSSEALRPLFTLGIEASSEAQFYTKGDQLILNLNNISSDRIQLMNSGIGWFQPDVLKNIITEIIHSILLPNQNGKLRSGVPVSLVKALGFEAAESSLTKDALVLTPASLWKPTSPVSQ

SEQ ID NO: 818037 - protein, 463 aa, Homo sapiens
MGKEKTHINIVVIGHVDSGKSTTTGHLIYKCGGIDKRTIEKFEKEAAEMGKGSFKYAWVLDKLKAERERGITIDISLWKFETTKYYITIIDAPGHRDFIKNMITGTSQADCAVLIVAAGVGEFEAGISKNGQTREHALLAYTLGVKQLIVGVNKMDSTEPAYSEKRYDEIVKEVSAYIKKIGYNPATVPFVPISGWHGDNMLEPSPNMPWFKGWKVERKEGNASGVSLLEALDTILPPTRPTDKPLRLPLQDVYKIGGIGTVPVGRVETGILRPGMVVTFAPVNITTEVKSVEMHHEALSEALPGDNVGFNVKNVSVKDIRRGNVCGDSKSDPPQEAAQFTSQVIILNHPGQISAGYSPVIDCHTAHIACKFAELKEKIDRRSGKKLEDNPKSLKSGDAAIVEMVPGKPMCVESFSQYPPLGRFAVRDMRQTVAVGVIKNVEKKSGGAGKVTKSAQKAQKAGK

SEQ ID NO: 818038 - protein, 133 aa, Homo sapiens
PLIYITGGVSEHIGRAFSADCAVLIVAAGVGEFEAGISKNGQTREHALLAYTLGVKQLIVGVNKMDSTEPAYSEKRYDEIVKEVSACFNEWNEGKRKRKEQKYEKENKTTKNARRHSTKKTSKRNKGEKRGKQ

SEQ ID NO: 818039 - protein, 644 aa, Homo sapiens
MSRQFSSRSGYRSGGGFSSGSAGIINYQRRTTSSSTRRSGGGGGRFSSCGGGGGSFGAGGGFGSRSLVNLGGSKSISISVARGGGRGSGFGGGYGGGGFGGGGFGGGGFGGGGIGGGGFGGFGSGGGGFGGGGFGGGGYGGGYGPVCPPGGIQEVTINQSLLQPLNVEIDPEIQKVKSREREQIKSLNNQFASFIDKVRFLEQQNQVLQTKWELLQQVDTSTRTHNLEPYFESFINNLRRRVDQLKSDQSRLDSELKNMQDMVEDYRNKYEDEINKRTNAENEFVTIKKDVDGAYMTKVDLQAKLDNLQQEIDFLTALYQAELSQMQTQISETNVILSMDNNRSLDLDSIIAEVKAQYEDIAQKSKAEAESLYQSKYEELQITAGRHGDSVRNSKIEISELNRVIQRLRSEIDNVKKQISNLQQSISDAEQRGENALKDAKNKLNDLEDALQQAKEDLARLLRDYQELMNTKLALDLEIATYRTLLEGEESRMSGECAPNVSVSVSTSHTTISGGGSRGGGGGGYGSGGSSYGSGGGSYGSGGGGGGGRGSYGSGGSSYGSGGGSYGSGGGGGGHGSYGSGSSSGGYRGGSGGGGGGSSGGRGSGGGSSGGSIGGRGSSSGGVKSSGGSSSVKFVSTTYSGVTR

SEQ ID NO: 818040 - protein, 637 aa, Homo sapiens
MSRQFSSRSGYRSGGGFSSGSAGIINYQRRTTSSSTRRSGGGGGRFSSCGGGGGSFGAGGGFGSRSLVNLGGSKSISISVARGGGRGSGFGGGYGGGGFGGGGFGGGGFGGGGIGGGGFGGFGSGGGGFGGGGFGGGGYGGGYGPVCPPGGIQEVTINQSLLQPLNVEIDPEIQKVKSREREQIKSLNNQFASFIDKVRFLEQQNQVLQTKWELLQQVDTSTRTHNLEPYFESFINNLRRRVDQLKSDQSRLDSELKNMQDMVEDYRNKYEDEINKRTNAENEFVTIKKDVDGAYMTKVDLQAKLDNLQQEIDFLTALYQAELSQMQTQISETNVILSMDNNRSLDLDSIIAEVKAQYEDIAQKSKAEAESLYQSKYEELQITAGRHGDSVRNSKIEISELNRVIQRLRSEIDNVKKQISNLQQSISDAEQRGENALKDAKNKLNDLEDALQQAKEDLARLLRDYQELMNTKLALDLEIATYRTLLEGEESRMSGECAPNVSVSVSTSHTTISGGGSRGGGGGGYGSGGSSYGSGGGSYGSGGGGGGGRGSYGSGGGSYGSGGGGGGHGSYGSGSSSGGYRGGSGGGGGGSSGGRGSGGGSSGGSIGGRGSSSGGVKSSGGSSSVKFVSTTYSGVTR

SEQ ID NO: 818041 - protein, 420 aa, Homo sapiens
MSRQFSSRSGYRSGGGFSSGSAGIINYQRRTTSSSTRRSGGGGGRFSSCGGGGGSFGAGGGFGSRSLVNLGGSKSISISVARGGGRGSGFGGGYGGGGFGGGGFGGGGFGGGGIGGGGFGGFGSGGGGFGGGGFGGGGYGGGYGPVCPPGGIQEVTINQSLLQPLNVEIDPEIQKVKSREREQIKSLNNQFASFIDKVRFLEQQNQVLQTKWELLQQVDTSTRTHNLEPYFESFINNLRRRVDQLKSDQSRLDSELKNMQDMVEDYRNKYARLKSQHTTDNMHADMTFGTIKTDVLMVRYMTKVGTFRATTRTNLASRDTRSEPINRHLIPKDSSRIYKNGRPPQSSRTLNEVQYQHTNRERTKRRKSTDTREHDMTIGMEGVKRGPKNTDGTTQAPRTQEHTAEETRRATRNRTAGKRI

SEQ ID NO: 818042 - protein, 155 aa, Homo sapiens
FVLLLRKNDRMSGECAPNVSVSVSTSHTTISGGGSRGGGGGGYGSGGSSYGSGGGSYGSGGGGGGGRGSYGSGGGSYGSGGGGGGHGSYGSGSSSGGYRGGSGGGGGGSSGGRGSGGGSSGGSIGGRGSSSGGVKSSGGSSSVKFVSTTYSGVTR

SEQ ID NO: 818043 - protein, 208 aa, Homo sapiens
MIRYCSLGPGDHLPGAVDILTKQASGSSFGSYPIEIPQSPGHCHWVSQDEGGGLAASILPCLLVCLGLSEEGGGPAFHLNTSLQGLRVSEGNPDSWGHFLMVLKAKQLCFCLCFQAHPFPLSSGLGMGAFLSGCERKDRNIFLWLTKTKGEVRKQEEVMVGAGVDSPGAKPIQLTRAPWGWSQLAHDAELESFFVFVFVLWLLQDIGT

SEQ ID NO: 818044 - protein, 208 aa, Homo sapiens; identical to SEQ ID NO: 818043

SEQ ID NO: 818045 - protein, 208 aa, Homo sapiens; identical to SEQ ID NO: 818043

SEQ ID NO: 818046 - protein, 190 aa, Homo sapiens
MLTKQASGSSFGSYPIEIPQSPGHCHWVSQDEGGGLAASILPCLLVAWVCLRKEGVPPSTSTHPFSDSESQKETLTPGAISYMVTVSQAALFCLCFQAHPFPLSSGLGMGAFLSGCERKDRNIFLWLTKTKGEVRKQEEVMVGAGVDSPGAKPIQLTRAPWGWSQLAHDAELESFFVFVFVLWLLQDIGT

SEQ ID NO: 818047 - protein, 208 aa, Homo sapiens; identical to SEQ ID NO: 818043

SEQ ID NO: 818048 - protein, 292 aa, Homo sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEKKEEEEEEEEYDEGSNLKKQTNKNRVQSGPRTPNPYASDNSSLMFPILVAFGVFIPTLFCLCRL

SEQ ID NO: 818049 - protein, 208 aa, Homo sapiens; identical to SEQ ID NO: 818043

SEQ ID NO: 818050 - protein, 292 aa, Homo sapiens; identical to SEQ ID NO: 818048

SEQ ID NO: 818051 - protein, 138 aa, Homo sapiens
MEGVPPSTSTHPFSDSESQKETLTPGAISYWYCKPSSFGFCLCFQAHPFPLSSGLGMGAFLSGCERKDRNIFLWLTKTKGEVRKQEEVMVGAGVDSPGAKPIQLTRAPWGWSQLAHDAELESFFVFVFVLWLLQDIGT

SEQ ID NO: 818052 - protein, 208 aa, Homo sapiens; identical to SEQ ID NO: 818043

SEQ ID NO: 818053 - protein, 292 aa, Homo sapiens; identical to SEQ ID NO: 818048

SEQ ID NO: 818054 - protein, 358 aa, Homo sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEKKEEEEEEEEYDEGSNLKKQTNKNRVQSGPRTPNPYASDNSSLMFPILVAFGVFIPTLFCLCRLAGWVCFGLSPSVAPEEGETEARQSDSTLKQNRKHPGTVQKSQKKSASLRWKDIINDQRALSSFSPN

SEQ ID NO: 818055 - protein, 113 aa, Homo sapiens
VTANCLLKHKAMDSEKHPDFVLFGGSGVGHGRGRVRWRQPRRKASSIHPYSFPGQPGSKPISYISLCRCQCMLWKGGLGFLTSQVRPIMVEEAALGSEWAAGPCLGELCGRKR

SEQ ID NO: 818056 - protein, 366 aa, Homo sapiens
MWPLWLCWALWVLPLAGPGAALTEEQLLGSLLRQLQLSEVPVLDRADMEKLVIPAHVRAQYVVLLRRSHGDRSRGKRFSQSFREVAGRFLASEASTHLLVFGMEQRLPPNSELVQAVLRLFQEPVPKAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 818057 - protein, 366 aa, Homo sapiens; identical to SEQ ID NO: 818056

SEQ ID NO: 818058 - protein, 105 aa, Homo sapiens
MSQKMKWLLTWNLLRICMNCIKKFLQMSSSWAGTLRAMTSQSTLCWIHEYYSREAPNPIHLTVDTSLQNGRMSIKAYVSTLMGVPGRTMGSDVHASDSEIRVLRH

SEQ ID NO: 818059 - protein, 124 aa, Homo sapiens
GPVGAQEVSVGSKAQAQEQLGPREPIGARVAECRRNLGASKSQGWAFSRVSQAPSRAQATAQTPAPALPGPALPGPFPGGRVVRLHPVILASIVDSYERRLQTQVFKLGLAQVHPPRSRADPPA

SEQ ID NO: 818060 - protein, 259 aa, Homo sapiens
IPFERLKVKLLSRQDGHTGGTSKCSSGHANPSPRRRPQPQFQRQRQHRLRLRFPLRLQPHPQTLRQQRLQLRLLARPRPQRKLQRRPQRPLCLVLLFQGPSPAAAWSGCTQSFWPPLWTATRDATRVLPELSGPCWELSTNTQWRSPIAFQCRTMSQKMKWLLTWNLLRICMNCIKKFLQMSSSWAGTLRAMTSQSTLCWIHEYYSREAPNPIHLTVDTSLQNGRMSIKAYVSTLMGVPGRTMGSDVHASDSEIRVLRH

SEQ ID NO: 818061 - protein, 105 aa, Homo sapiens; identical to SEQ ID NO: 818058

SEQ ID NO: 818062 - protein, 105 aa, Homo sapiens; identical to SEQ ID NO: 818058

SEQ ID NO: 818063 - protein, 251 aa, Homo sapiens
TQNKLGSRAVLMERHGDSKSPPARQPSPGGAQFQRQRQHRLRLRFPLRLQPHPQTLRQQRLQLRLLARPRPQRKLQRRPQRPLCLVLLFQGPSPAAAWSGCTQSFWPPLWTATRDATRVLPELSGPCWELSTNTQWRSPIAFQCRTMSQKMKWLLTWNLLRICMNCIKKFLQMSSSWAGTLRAMTSQSTLCWIHEYYSREAPNPIHLTVDTSLQNGRMSIKAYVSTLMGVPGRTMGSDVHASDSEIRVLRH

SEQ ID NO: 818064 - protein, 105 aa, Homo sapiens; identical to SEQ ID NO: 818058

SEQ ID NO: 818065 - protein, 105 aa, Homo sapiens; identical to SEQ ID NO: 818058

SEQ ID NO: 818066 - protein, 105 aa, Homo sapiens; identical to SEQ ID NO: 818058

SEQ ID NO: 818067 - protein, 105 aa, Homo sapiens; identical to SEQ ID NO: 818058

SEQ ID NO: 818068 - protein, 105 aa, Homo sapiens; identical to SEQ ID NO: 818058

SEQ ID NO: 818069 - protein, 105 aa, Homo sapiens; identical to SEQ ID NO: 818058

SEQ ID NO: 818070 - protein, 105 aa, Homo sapiens; identical to SEQ ID NO: 818058

SEQ ID NO: 818071 - protein, 155 aa, Homo sapiens
NYRLGTRLVGIRPRQMATPAVPVSAPPATPTPVPGGGPSLSSSANASTGCGSGSRCGSSLILRPCGSSGCNCGSWPDPGLSASSSADPSARSAWSCSSRALPRRPRGQAAPSHFGLHCGQLRETQRGCCPSYRDPVGNCRQTLSGGHQLLFSAAQ

SEQ ID NO: 818072 - protein, 155 aa, Homo sapiens; identical to SEQ ID NO: 818071

SEQ ID NO: 818073 - protein, 155 aa, Homo sapiens; identical to SEQ ID NO: 818071

SEQ ID NO: 818074 - protein, 155 aa, Homo sapiens; identical to SEQ ID NO: 818071

SEQ ID NO: 818075 - protein, 70 aa, Homo sapiens
RAMTSQSTLCWIHEYYSREAPNPIHLTVDTSLQNGRMSIKAYVSTLMGVPGRTMGSDVHASDSEIRVLRH

SEQ ID NO: 818076 - protein, 351 aa, Homo sapiens
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 818077 - protein, 128 aa, Homo sapiens
MVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 818078 - protein, 310 aa, Homo sapiens
SDLEDPVCYPQHIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 818079 - protein, 392 aa, Homo sapiens
LSQPPGEAMNATGTPVAPESCQQLAAGGHSRLIVLHYNHSGRLAGRGGPEDGGLGALRGLSVAASCLVVLENLLVLAAITSHMRSRRWVYYCLVNITLSDLLTGAAYLANVLLSGARTFRLAPAQWFLREGLLFTALAASTFSLLFTAGERFATMVRPVAESGATKTSRVYGFIGLCWLLAALLGMLPLLGWNCLCAFDRCSSLLPLYSKRYILFCLVIFAGVLATIMGLYGAIFRLVQASGQKAPRPAARRKARRLLKTVLMILLAFLVCWGPLFGLLLADVFGSNLWAQEYLRGMDWILALAVLNSAVNPIIYSFRSREVCRAVLSFLCCGCLRLGMRGPGDCLARAVEAHSGASTTDSSLRPRDSFRGSRSLSFRMREPLSSISSVRSI

SEQ ID NO: 818080 - protein, 365 aa, Homo sapiens
MNVIYPLAVPKGRRLCCEVCEAPAERVCAACTVTYYCGVVHQKADWDSIHEKICQLLIPLRTSMPFYNSEEERQHGLQQLQQRQKYLIEFCYTIAQKYLFEGKHEDAVPAALQSLRFRVKLYGLSSVELVPAYLLLAEASLGLGRIVQAEEYLFQAQWTVLKSTDCSNATHSLLHRNLGLLYIAKKNYEEARYHLANDIYFASCAFGTEDIRTSGGYFHLANIFYDLKKLDLADTLYTKVSEIWHAYLNNHYQVLSQAHIQQMDLLGKLFENDTGLDEAQEAEAIRILTSILNIRESTSDKAPQKTIFVLKILVMLYYLMMNSSKAQEYGMRALSLAKEQQLDVHEQSTIQELLSLISTEDHPIT

SEQ ID NO: 818081 - protein, 365 aa, Homo sapiens; identical to SEQ ID NO: 818080

SEQ ID NO: 818082 - protein, 255 aa, Homo sapiens
MSALDSTAHFHALLQFRGRTAAWPAAAAAAAGLGRIVQAEEYLFQAQWTVLKSTDCSNATHSLLHRNLGLLYIAKKNYEEARYHLANDIYFASCAFGTEDIRTSGGYFHLANIFYDLKKLDLADTLYTKVSEIWHAYLNNHYQVLSQAHIQQMDLLGKLFENDTGLDEAQEAEAIRILTSILNIRESTSDKAPQKTIFVLKILVMLYYLMMNSSKAQEYGMRALSLAKEQQLDVHEQSTIQELLSLISTEDHPIT

SEQ ID NO: 818083 - protein, 103 aa, Homo sapiens [sequence omitted]

SEQ ID NO: 818084 - protein, 214 aa, Homo sapiens
MNVIYPLAVPKGRRLCCEVCEAPAERVCAACTVTYYCGVVHQKADWDSIHEKICQLLIPLRTSMPFYNSEEERQHGLQQLQQRQKYLIEFCYTIAQKYLFEGKHEDAVPAALQSLRFRVKLYGLSSVELVPAYLLLAEASLGLGRIVQAEEYLFQAQWTVLKSTDCSNATHSLLHRNLGLLYIAKKNYEEARYHLANDVNKLSYNTCIFPKSKL

SEQ ID NO: 818085 - protein, 202 aa, Homo sapiens
MAVPAALILRESPSMKKAVSLINAIDTGRFPRLLTRILQKLHLKAESSFSEEEEEKLQAAFSLEKQDLHLVLETISFILEQAVYHNVKPAALQQQLENIHLRQDKAEAFVNTWSSMGQETVEKFRQRILAPCKLETVGWQLNLQMAHSAQAKLKSPQAVLQLGVNNEDSKSLEKVLVEFSHKELFDFYNKLETIQAQLDSLT

SEQ ID NO: 818086 - protein, 202 aa, Homo sapiens; identical to SEQ ID NO: 818085

SEQ ID NO: 818087 - protein, 202 aa, Homo sapiens; identical to SEQ ID NO: 818085

SEQ ID NO: 818088 - protein, 202 aa, Homo sapiens; identical to SEQ ID NO: 818085

SEQ ID NO: 818089 - protein, 188 aa, Homo sapiens
MKKAVSLINAIDTGRFPRLLTRILQKLHLKAESSFSEEEEEKLQAAFSLEKQDLHLVLETISFILEQAVYHNVKPAALQQQLENIHLRQDKAEAFVNTWSSMGQETVEKFRQRILAPCKLETVGWQLNLQMAHSAQAKLKSPQAVLQLGVNNEDSKSLEKVLVEFSHKELFDFYNKLETIQAQLDSLT

SEQ ID NO: 818090 - protein, 184 aa, Homo sapiens
MAVPAALILRESPSMKKAVSLINAIDTGRFPRLLTRILQKLHLKAESSFSEEEEEKLQAAFSLEKQDLHLVLETISFILEQAVYHNVKPAALQQQLENIHLRQDKAEAFVNTWSSMGQETVELNLQMAHSAQAKLKSPQAVLQLGVNNEDSKSLEKVLVEFSHKELFDFYNKLETIQAQLDSLT

SEQ ID NO: 818091 - protein, 165 aa, Homo sapiens
MAVPAALILRESPSMKKAVSLINAIDTGRFPRLLTRILQKLHLKAESSFSEEEEEKLQAAFSLEKQDLHLVLETISFILEQAVYHNVKPAALQQQLENIHLRQDKAEAFVNTWSSMGQETVEKFRQRILAPCKLETVGWQLNLQMAHSAQEPGESSCGIQSQGVV

SEQ ID NO: 818092 - protein, 165 aa, Homo sapiens
MAVPAALILRESPSMKKAVSLINAIDTGRFPRLLTRILQKLHLKAESSFSEEEEEKLQAAFSLEKQDLHLVLETISFILEQAVYHNVKPAALQQQLENIHLRQDKAEAFVNTWSSMGQETVEKFRQRILAPCKSLEKVLVEFSHKELFDFYNKLETIQAQLDSLT

SEQ ID NO: 818093 - protein, 208 aa, Homo sapiens
MAVPAALILRESPSMKKAVSLINAIDTGRFPRLLTRILQKLHLKAESSFSEEEEEKLQAAFSLEKQDLHLVLETISFILEQAVYHNVKPAALQQQLENIHLRQDKAEAFVNTWSSMGQETVEKFRQRILAPCKLETVGWQLNLQMAHSAQAKLKSPQAVLQLGVNNEDSKRALGEKFLVEIQSPRELVGFPINTALRTFQTPTVDFPF

SEQ ID NO: 818094 - protein, 184 aa, Homo sapiens
MAVPAALILRESPSMKKAVSLINAIDTGRFPRLLTRILQKLHLKAESSFSEEEEEKLQAAFSLEKQDLHLVLETISFILEQAVYHNVKPAALQQQLENIHLRQDKAEAFVNTWSSMGQETVEKFRQRILAPCKLETVGWQLNLQMAHSAQAKLKSPQAVLQLGVNNEDSKGKKWYPIKRMYFVC

SEQ ID NO: 818095 - protein, 71 aa, Homo sapiens
GGRGRHVPPLSANAEPRAEVTCLCLALLCAPGSVGAQSVVRRLGLSRTFLIPVDCAEYTACRLSSIHHGFF

SEQ ID NO: 818096 - protein, 100 aa, Homo sapiens
DAWVLDAWVGGSEGAGLSLSQLIVQNTLPVACLLFTMASSDIQVKELEKRASGQAFELILSPRSKESVPEFPLSPPKKKDLSLEEIQKKLEAAEERRKSP

SEQ ID NO: 818097 - protein, 82 aa, Homo sapiens
GKKYTTGSTVFNGARAYELSMQDIQVKELEKRASGQAFELILSPRSKESVPEFPLSPPKKKDLSLEEIQKKLEAAEERRKSP

SEQ ID NO: 818098 - protein, 71 aa, Homo sapiens; identical to SEQ ID NO: 818095

SEQ ID NO: 818099 - protein, 112 aa, Homo sapiens
MASSDIQVKELEKRASGQAFELILSPRSKESVPEFPLSPPKKKDLSLEEIQKKLEAAEERRKVNEAIHRKQDINLCNGQINFISITGRKQNCSYTVIITYASDWKEIPVLIY

SEQ ID NO: 818100 - protein, 89 aa, Homo sapiens
MFAGHLFSSYQMQEVRRKMVDRTRRWSVRTRGTECSLQKRPKHSDVYKQQPGRQARGRTLEDEGQTTSLNATNATQDQTQTGKETHSHD

SEQ ID NO: 818101 - protein, 69 aa, Homo sapiens
RARYPSYIVYIQVKELEKRASGQAFELILSPRSKESVPEFPLSPPKKKDLSLEEIQKKLEAAEERRKSP

SEQ ID NO: 818102 - protein, 83 aa, Homo sapiens
MEANTRETEKAQMDAKLERLREKDKHIEEVRKNKESKDPADETEADYLSDHLTFSTIPYLNIQRLYWARGQKNKKPTDKTVEA

SEQ ID NO: 818103 - protein, 69 aa, Homo sapiens; identical to SEQ ID NO: 818101

SEQ ID NO: 818104 - protein, 38 aa, Homo sapiens
MAAKLATFAREDKHIEEVRKNSPRINLVDQPESCAHPS

SEQ ID NO: 818105 - protein, 949 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLMGDEPEGIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTDLELSLKCRAPEVSQHVYQAYETILKN

SEQ ID NO: 818106 - protein, 942 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTDLELSLKCRAPEVSQHVYQAYETILKN

SEQ ID NO: 818107 - protein, 880 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSERPPLATSSVQMGAVDLLGGGLDSLIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTDLELSLKCRAPEVSQHVYQAYETILKN

SEQ ID NO: 818108 - protein, 993 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQAPASSLPWAFYLEQEAESHSPRESVYIHCPGVFQQIAPSGAPAPSFLFEATVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTDLELSLKCRAPEVSQHVYQAYETILKN

SEQ ID NO: 818109 - protein, 721 aa, Homo sapiens
AGDLEDPISEQDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTDLELSLKCRAPEVSQHVYQAYETILKN

SEQ ID NO: 818110 - protein, 924 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTDLAGVRADV

SEQ ID NO: 818111 - protein, 461 aa, Homo sapiens
VLTDIVYFSLNEYSMLRPRMLLQQVLSLFLSDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTDLELSLKCRAPEVSQHVYQAYETILKN

SEQ ID NO: 818112 - protein, 355 aa, Homo sapiens
TKKPVQKALMYLFTHPCDCAIPFLPLFLGEKGKWLFCALAQFGRNPAAQLSPPVSGPPLATSSVQMGAVDLLGGGLDSLIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTDLELSLKCRAPEVSQHVYQAYETILKN

SEQ ID NO: 818113 - protein, 226 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMNTAFGLLGMGPEGQPLGRRVASGPSPGEGISPQSAQAPQAPGDNHVVPVLR

SEQ ID NO: 818114 - protein, 78 aa, Homo sapiens
ALRLPSGDVLRHTGAVTALLRPVAGPSTQELAAMAVTLPSQTSGSTSDPRNVPANVEGIFSQGLSLVFCSPGILPHHQ

SEQ ID NO: 818115 - protein, 75 aa, Homo sapiens
MDLLWEWEWGRSGAVWTALSGTVRRLSACPGGQLCLEAGVSLTFLRHPDASTLLLCPGRSESAESPETAPTGAPP

SEQ ID NO: 818116 - protein, 45 aa, Homo sapiens
MLKYRFPAGTMALSSVAQWSSSEDAKIHEKTSRTSGRIFNGKSLG

SEQ ID NO: 818117 - protein, 133 aa, Homo sapiens
MRPAPHTEHRSTQDAEGHSRDTDADPEYNSTRRKRQEGNAAEQKSHTEHERKRVEKHQIRRRAKKQKAQSETKRKERKKKEGGSKEGPHSSDHNNMNRETQSMKRDLRPNEKEKKQDHKRQQQRTKPKQQTEN

SEQ ID NO: 818118 - protein, 45 aa, Homo sapiens; identical to SEQ ID NO: 818116

SEQ ID NO: 818119 - protein, 45 aa, Homo sapiens; identical to SEQ ID NO: 818116

SEQ ID NO: 818120 - protein, 45 aa, Homo sapiens; identical to SEQ ID NO: 818116

SEQ ID NO: 818121 - protein, 133 aa, Homo sapiens; identical to SEQ ID NO: 818117

SEQ ID NO: 818122 - protein, 133 aa, Homo sapiens
MRPAPHTEHRSTQDAEGHSRELDADPEYNSTRRKRQEGNAAEQKSHTEHERKRVEETSNQTKSEEAESTERDKAKRKEEERRRKQRRTTQQRPQHMNRETQSMKRDLRPNEKEKKQDHKRQQQRTKPKQQTEN

SEQ ID NO: 818123 - protein, 114 aa, Homo sapiens
MRLLILALLGICSLTAYIVEGVGSEVSDKRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 818124 - protein, 1192 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 818125 - protein, 1192 aa, Homo sapiens; identical to SEQ ID NO: 818124

SEQ ID NO: 818126 - protein, 1192 aa, Homo sapiens; identical to SEQ ID NO: 818124

SEQ ID NO: 818127 - protein, 1192 aa, Homo sapiens; identical to SEQ ID NO: 818124

SEQ ID NO: 818128 - protein, 1192 aa, Homo sapiens; identical to SEQ ID NO: 818124

SEQ ID NO: 818129 - protein, 1158 aa, Homo sapiens
SGAYVVLAEFELYGGAEGEKEGNVTGRMTVALKGPQLRCSALQLLLQMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 818130 - protein, 1013 aa, Homo sapiens
VLVFDVINGLPQYPRLVHLGVCPHDQVFQFDDFVIDGGAISFLNDIMGCPPFSFFGGLKLLRSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 818131 - protein, 1075 aa, Homo sapiens
MRGYEGEAGIRGDEEEVGIVTNDSIRNLNAEGQRFDGGSHTQSLSANSLSSAPCCALAIVNKSDVNAPHTLTYLSCLLWPPQPSTSSLNPSSAEPTPSHINTELHLNQLHVSWVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 818132 - protein, 1225 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGVYGKKSGATHSIEEELNIHISRGKEPEHSSAAGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 818133 - protein, 1222 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNSKCAEKRLVSPGPGGALKSRSFSPGGVFFAELLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 818134 - protein, 1170 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPKLPAPWRRWATGAPATTASR

SEQ ID NO: 818135 - protein, 720 aa, Homo sapiens
FNEGDGDLIVTLDGPVVPYTLGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 818136 - protein, 722 aa, Homo sapiens
ISVLGPGCKFYINWSVRPLTLKMGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 818137 - protein, 1192 aa, Homo sapiens; identical to SEQ ID NO: 818124

SEQ ID NO: 818138 - protein, 606 aa, Homo sapiens [sequence omitted]

SEQ ID NO: 818139 - protein, 556 aa, Homo sapiens
MQGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 818140 - protein, 1315 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTDHLHPHHQPWQLCPVTKIAFSTWHNRRAFDIPLLEIHVCVLGAFGTSDGQPCLLTPRLFLIGSEYSKRNCKMLQDRKAPRGPILRAKAVAFPIKQTLNRRQEGAEKTADVMVKPVSLTSSIERRSPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 818141 - protein, 1082 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTEPAEPCMPHSLGKQMGSRVPSAIARGPVATYGAASTSVGPPLTLPSTTWSSCSPVTCYCRYGQRSGKNRPVPARLWGRPTTRQALNWRASNGTWAACAGWHTASAQHTARCSCMKPPCA

SEQ ID NO: 818142 - protein, 1072 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQCSCMKPPCA

SEQ ID NO: 818143 - protein, 274 aa, Homo sapiens
TDIISRSRCISSRGSCWHFWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 818144 - protein, 1122 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLSCCSVLILSLGLRSLPWA

SEQ ID NO: 818145 - protein, 990 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHLFASSVFIRLSLGDSSL

SEQ ID NO: 818146 - protein, 238 aa, Homo sapiens
ASSSMTATRSLVKQFFRLHKSCCACCHVCELSSRKYSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 818147 - protein, 342 aa, Homo sapiens
CTRCSAVVTTNLLCCFRGCVYYCVIFFLCLTEACSPSKYLCGWLSSGFFSLSVGFLPVVFLSATKCSLSPSFRTVARVHKKHLWPKRHRNICPLRTSSSDFIVNPPGHCSHVCRPGKRDLIQALINPHGGVSYPGTGSDGFLGIQPCAHARNALGCAVCPSVLRGHTSLAVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 818148 - protein, 1028 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVAAANKKH

SEQ ID NO: 818149 - protein, 981 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTECVTLLGHSLASLQGNLV

SEQ ID NO: 818150 - protein, 1016 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTDHLHPHHQPWQLCPVTKIAFSTWHNRRAFDIPLWRFMSASWGHSALVMGSPAC

SEQ ID NO: 818151 - protein, 799 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLAVSTLRFPSVNLP

SEQ ID NO: 818152 - protein, 584 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGRWRPLA

SEQ ID NO: 818153 - protein, 349 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTASPPLSRRLPFKYQPWWAAVGPF

SEQ ID NO: 818154 - protein, 437 aa, Homo sapiens
ARAQRKHGGGWHPSVRRCRAGVVGCHGRWRRHRPRVSLSGTAGGASALSRAMDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKVGAKQNCVLCSTISPLPVFASGA

SEQ ID NO: 818155 - protein, 437 aa, Homo sapiens; identical to SEQ ID NO: 818154

SEQ ID NO: 818156 - protein, 849 aa, Homo sapiens
MAAAAPAAAAASSEAPAASATAEPEAGDQDSREVRVLQSLRGKICEAKNLLPYLGPHKMRDCFCTINLDQEEVYRTQVVEKSLSPFFSEEFYFEIPRTFQYLSFYVYDKNVLQRDLRIGKVAIKKEDLCNHSGKETWFSLQPVDSNSEVQGKVHLELKLNELITENGTVCQQLVVHIKACHGLPLINGQSCDPYATVSLVGPSRNDQKKTKVKKKTSNPQFNEIFYFEVTRSSSYTRKSQFQVEEEDIEKLEIRIDLWNNGNLVQDVFLGEIKVPVNVLRTDSSHQAWYLLQPRDNGNKSSKTDDLGSLRLNICYTEDYVLPSEYYGPLKTLLLKSPDVQPISASAAYILSEICRDKNDAVLPLVRLLLHHDKLVPFATAVAELDLKDTQDANTIFRGNSLATRCLDEMMKIVGGHYLKVTLKPILDEICDSSKSCEIDPIKLKEGDNVENNKENLRYYVDKLFNTIVKSSMSCPTVMCDIFYSLRQMATQRFPNDPHVQYSAVSSFVFLRFFAVAVVSPHTFHLRPHHPDAQTIRTLTLISKTIQTLGSWGSLSKSKSSFKETFMCEFFKMFQEEGYIIAVKKFLDEISSTETKESSGTSEPVHLKEGEMYKRAQGRTRIGKKNFKKRWFCLTSRELTYHKQPGKDAIYTIPVKNILAVEKLEESSFNKKNMFQVIHTEKPLYVQANNCVEANEWIDVLCRVSRCNQNRLSFYHPSVYLNGNWLCCQETGENTLGCKPCTAGVPADIQIDIDEDRETERIYSLFTLSLLKLQKMEEACGTIAVYQGPQKEPDDYSNFVIEDSVTTFKTIQQIKSIIEKLDEPHEKYRKKRSSSAKYGSKENPIVGKAS

SEQ ID NO: 818157 - protein, 849 aa, Homo sapiens; identical to SEQ ID NO: 818156

SEQ ID NO: 818158 - protein, 849 aa, Homo sapiens; identical to SEQ ID NO: 818156

SEQ ID NO: 818159 - protein, 849 aa, Homo sapiens; identical to SEQ ID NO: 818156

SEQ ID NO: 818160 - protein, 278 aa, Homo sapiens [sequence omitted]

SEQ ID NO: 818161 - protein, 926 aa, Homo sapiens
MYKRAQGRTRIGKKNFKKRWFCLTSRELTYHKQPGKDAIYTIPVKNILAVEKLEESSFNKKNMFQVIHTEKPLYVQANNCVEANEWIDVLCRVSRCNQNRLSFYHPSVYLNGNWLCCQETGENTLGCKPCTAGVPADIQIDIDEDRETERIYSLFTLSLLKLQKMEEACGTIAVYQGPQKEPDDYSNFVIEDSVTTFKTIQQIKSIIEKLDEPHEKYRKKRSSSAKYGSKENPIVGKASLSLTDWFRRTGKYYFSWSFSIHHVFCSWYLRMSIRFNVICLHIVFNNLIIEINCLGILVLMYYREFKAQDSLHTCVTKSMFLQLLFNRKNLPEKSFVTKGELLRSKKTISSCNTLFCGLVFTTISACSILPTLCFTRKFQFMTVQSFSFSSCRPSHFKKRKKIRSVFPLVHQSLQVPFKTVIETLENCQSILESWEILLPKDVNKTQDRRNQGICAIVCILFTFGISDGKRSNETTEIVFIVLNTRYSFSGFESLTWLLRTSLQKESKQGMKVVGKSLHSPTISCCNKGHHKDALLIVFGSDLPENSHLAHFNNLDCSRFDFRYSMVSSLYDQLNDQCLSLKKCFPENVYISLLFPYCLLAKWNLGKQLFEDFFTLEIYFVLKTLTVNKQSKQVATLKLRDTLCFISIKNHGTLILSFLIQNIFYMWYFEPWSIYMFLFKTVTFNVSLLVVLFLSEHKLYFKIYFANFVIGGKSFLNYIVIRELFLKTTGIQSKLFHEKNITEQCISLNDFVKINELCLSLHYGGYYSQLILKTSLKESFKFYKLVDSINYTDFIHLKEFEPFNKFLILNIAFRLKFLLRVSEMSACEEHVNIARYQSLFFSGFLVLCFVFLRQKKYASSISNTKSPIVIVLKIMVMITGTKAVCIYNSGFERRRVQPSSSFLHMTLLNSQFDWNYTNLAQPKKGVM

SEQ ID NO: 818162 - protein, 935 aa, Homo sapiens
MYKRAQGRTRIGKKNFKKRWFCLTSRELTYHKQPGKDAIYTIPVKNILAVEKLEESSFNKKNMFQVIHTEKPLYVQANNCVEANEWIDVLCRVSRCNQNRLSFYHPSVYLNGNWLCCQETGENTLGCKPCTAGVPADIQIDIDEDRETERIYSLFTLSLLKLQKMEEACGTIAVYQGPQKEPDDYSNFVIEDSVTTFKTIQQIKSIIEKLDEPHEKYRKKRSSSAKYGSKENPIVGKASLSLTDWFRRTGKYYFSWSFSIHHVFCSWYLRMSIRFNVICLHIVFNNLIIEINCLGILVLMYYREFKAQDSLHTCVTKSMFLQLLFNRKNLPEKSFVTKGELLRSKKTISSCNTLFCGLVFTTISACSILPTLCFTRKFQFMTVQSFSFSSCRPSHFKKRKKIRSVFPLVHQSLQVPFKTVIETLENCQSILESWEILLPKDVNKTQDRRNQGICAIVCILFTFGISDGKRSNETTEIVFIVLNTRYSFSGFESLTWLLRTSLQKESKQGMKVVGKSLHSPTISCCNKGHHKDALLIVFGSDLPENSHLAHFNNLDCSRFDFRYSMVSSLYDQLNDQCLSLKIMLPENVYISLLFPYCLLAKWNLGKQLFEDFFTLEIYFVLKTLTVNKQSKQVATLKLRDTLCFISIKNHGTLILSFLIQNIFYMWYFEPWSIYMFLFKTVTFNVSLLVVLFLSEHKLYFKIYFANFVIGGKSFLNYIVIRELFLKTTGIQSKLFHEKNITEQCISLNDFVKINELCLSLHYGGYYSQLILKTSLKESFKFYKLVDSINYTDFIHLKEFSHLKISYSQIAFRLKFLLRVSEMSACEEHVNIARYQSLFFSGFLVLCFFFKGKRNMHLAFLIPNPQCDCFKDHGMITGTKAVCIYNSGFERRRVQPSSSFLHMTLLNSQFDLELTNLAQPKKGDNVKLNYFSLKVF

SEQ ID NO: 818163 - protein, 239 aa, Homo sapiens [sequence omitted]

SEQ ID NO: 818164 - protein, 404 aa, Homo sapiens
MAAAAPAAAAASSEAPAASATAEPEAGDQDSREVRVLQSLRGKICEAKNLLPYLGPHKMRDCFCTINLDQEEVYRTQVVEKSLSPFFSEEFYFEIPRTFQYLSFYVYDKNVLQRDLRIGKVAIKKEDLCNHSGKETWFSLQPVDSNSEVQGKVHLELKLNELITENGTVCQQLVVHIKACHGLPLINGQSCDPYATVSLVGPSRNDQKKTKVKKKTSNPQFNEIFYFEVTRSSSYTRKSQFQVEEEDIEKLEIRIDLWNNGNLVQDVFLGEIKVPVNVLRTDSSHQAWYLLQPRDNGNKSSKTDDLGSLRLNICYTEDYVLPSEYYGPLKTLLLKSPDVQPISASAAYILSEICRDKNDAVLPLVRLLLHHDKLVPFATAVAELDLKDTQDANTIFNKEVPSSI

SEQ ID NO: 818165 - protein, 629 aa, Homo sapiens
MAAAAPAAAAASSEAPAASATAEPEAGDQDSREVRVLQSLRGKICEAKNLLPYLGPHKMRDCFCTINLDQEEVYRTQVVEKSLSPFFSEEFYFEIPRTFQYLSFYVYDKNVLQRDLRIGKVAIKKEDLCNHSGKETWFSLQPVDSNSEVQGKVHLELKLNELITENGTVCQQLVVHIKACHGLPLINGQSCDPYATVSLVGPSRNDQKKTKVKKKTSNPQFNEIFYFEVTRSSSYTRKSQFQVEEEDIEKLEIRIDLWNNGNLVQDVFLGEIKVPVNVLRTDSSHQAWYLLQPRDNGNKSSKTDDLGSLRLNICYTEDYVLPSEYYGPLKTLLLKSPDVQPISASAAYILSEICRDKNDAVLPLVRLLLHHDKLVPFATAVAELDLKDTQDANTIFRGNSLATRCLDEMMKIVGGHYLKVTLKPILDEICDSSKSCEIDPIKLKEGDNVENNKENLRYYVDKLFNTIVKSSMSCPTVMCDIFYSLRQMATQRFPNDPHVQYSAVSSFVFLRFFAVAVVSPHTFHLRPHHPDAQTIRTLTLISKTIQTLGSWGSLSKSKSSFKETFMCEFFKMFQEEGYIIAVKKFLDEISSTETKESSGTSEPVHLKEGEMYELMEELGLEQPVVVLCL

SEQ ID NO: 818166 - protein, 352 aa, Homo sapiens
ERRSRAAPEPRFSQWRRRDGRAGSARRRVLSFEPRCSELVGGPRGERGSLGGEPGVSCLKMHSDAAAVNFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSLQCDTTEKLRNTLDYLRSFLNDSTNFKLIYRYAFDFAREKDQRSLDINTAKCMLGLLLGKIWPLFPVFHQFLEQSKYKVINKDQWCNVLEFSRTINLDLSNYDEDGAWPVLLDEFVEWYKDKQMS

SEQ ID NO: 818167 - protein, 327 aa, Homo sapiens
QIWPGSFEPRCSELVGGPRGERGSLGGEPGVSCLKMHSDAAAVNFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSLQCDTTEKLRNTLDYLRSFLNDSTNFKLIYRYAFDFAREKDQRSLDINTAKCMLGLLLGKIWPLFPVFHQFLEQSKYKVINKDQWCNVLEFSRTINLDLSNYDEDGAWPVLLDEFVEWYKDKQMS

SEQ ID NO: 818168 - protein, 352 aa, Homo sapiens; identical to SEQ ID NO: 818166

SEQ ID NO: 818169 - protein, 284 aa, Homo sapiens
ERRSRAAPEPRFSQWRRRDGRAGSARRRVLSFEPRCSELVGGPRGERGSLGGEPGVSCLKMHSDAAAVNFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSLQCDTTEKLRNTLDYLRSFLNDSTNFKLIYRYAFDFARAEDGVSDCELLAGTLAEQE

SEQ ID NO: 818170 - protein, 290 aa, Homo sapiens
ERRSRAAPEPRFSQWRRRDGRAGSARRRVLSFEPRCSELVGGPRGERGSLGGEPGVSCLKMHSDAAAVNFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSLQCDTTEKLRNTLDYLRSFLNDSTNFKLIYRYAFDFARAEDGVSDCELLAGTLAEQEKRTSAA

SEQ ID NO: 818171 - protein, 178 aa, Homo sapiens
QIWPGSFEPRCSELVGGPRGERGSLGGEPGVSCLKMHSDAAAVNFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVSQTY

SEQ ID NO: 818172 - protein, 198 aa, Homo sapiens
GWTCDEGPRSECPGCMEVEAALGCSGQGRGCGGVAPAGRGRERASERGTRVRISKGLSGAGGSVRKADFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENF

SEQ ID NO: 818173 - protein, 81 aa, Homo sapiens
QIWPGSFEPRCSELVGGPRGERGSLGGEPGVSCLKMHSDAAAVNFQLNSHLSTLANIHKIYHTLNKLEVCGLAVLQTALIK

SEQ ID NO: 818174 - protein, 104 aa, Homo sapiens
LLHSMVCCCRLPHLCYREKDQRSLDINTAKCMLGLLLGKIWPLFPVFHQFLEQSKYKVINKDQWCNVLEFSRTINLDLSNYDEDGAWPVLLDEFVEWYKDKQMS

SEQ ID NO: 818175 - protein, 317 aa, Homo sapiens
ERRSRAAPEPRFSQWRRRDGRAGSARRRVLSFEPRCSELVGGPRGERGSLGGEPGVSCLKMHSDAAAVNFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSLQCDTTEKLRNTLDYLRSFLNDSTNFKLIYRYAFDFARQSKYKVINKDQWCNVLEFSRTINLDLSNYDEDGAWPVLLDEFVEWYKDKQMS

SEQ ID NO: 818176 - protein, 352 aa, Homo sapiens; identical to SEQ ID NO: 818166

SEQ ID NO: 818177 - protein, 352 aa, Homo sapiens; identical to SEQ ID NO: 818166

SEQ ID NO: 818178 - protein, 135 aa, Homo sapiens
QIWPGSFEPRCSELVGGPRGERGSLGGEPGVSCLKMHSDAAAVNFQLNSHLSTLANIHKIYHTLNKLNLTEDIGQDDHQTGSLRSCSSSDCFNKVMPPRKKRRPASGDDLSAKKSRHDRSHSFTSTTELERSSCT

SEQ ID NO: 818179 - protein, 283 aa, Homo sapiens
ERRSRAAPEPRFSQWRRRDGRAGSARRRVLSFEPRCSELVGGPRGERGSLGGEPGVSCLKMHSDAAAVNFQLNSHLSTLANIHKIYHTLNKLNLTEDIGQDDHQTGSLRSCSSSDCFNKVMPPRKKRRPASGDDLSAKKSRHDSMYRKYDSTRIKTEEEAFSSKRCLEWFYEYAGTDDVVGPEGMEKFCEDIGVEPENVVMLVLAWKLDAQNMGYFTLQEWLKGMTSLQCDTTEKLRNTLDYLRSFLNDSTNFKLIYRYAFDFARPGIKIPLFIKEPIGCHCS

SEQ ID NO: 818180 - protein, 129 aa, Homo sapiens
QIWPGSFEPRCSELVGGPRGERGSLGGEPGVSCLKMHSDAAAVNFQLNSHLSTLANIHKIYHTLNKLNLTEDIGQDDHQTGSLRSCSSSDCFNKVMPPRKKRRPASGDDLSAKKSRHDRYDVETVDQNQ

SEQ ID NO: 818181 - protein, 201 aa, Homo sapiens
MRRAWILLTLGLVACVSAESRAELTSDKDMYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKKDEGSYDLGERKPSSAAYQKAPTKEFYA

SEQ ID NO: 818182 - protein, 167 aa, Homo sapiens
FKRTEVLAAVIAGGVIGFLFAIFLILLLTSAAPKVETTTLNIQNKIPAQTKSPEETDKEKVHLSDSERKMDPAEEDTNVYTEKHSDSLFKRTEVLAAVIAGGVIGFLFAIFLILLLTSAAPKVETTTLNIQNKIPAQTKSPEETDKEKVHLSDSERKMTQPKTDTNA

SEQ ID NO: 818183 - protein, 201 aa, Homo sapiens; identical to SEQ ID NO: 818181

SEQ ID NO: 818184 - protein, 172 aa, Homo sapiens
MYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKKDEGSYDLGERKPSSAAYQKAPTKEFYA

SEQ ID NO: 818185 - protein, 234 aa, Homo sapiens
LEHTAVKGEDAERSGSGLGLGHLQGTRFLSGIRRAPLYKRHPTGTANISGTFQRAELTSDKDMYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKKDEGSYDLGERKPSSAAYQKAPTKEFYA

SEQ ID NO: 818186 - protein, 201 aa, Homo sapiens; identical to SEQ ID NO: 818181

SEQ ID NO: 818187 - protein, 201 aa, Homo sapiens; identical to SEQ ID NO: 818181

SEQ ID NO: 818188 - protein, 201 aa, Homo sapiens; identical to SEQ ID NO: 818181

SEQ ID NO: 818189 - protein, 201 aa, Homo sapiens; identical to SEQ ID NO: 818181

SEQ ID NO: 818190 - protein, 290 aa, Homo sapiens
MDIEAYLERIGYKKSRNKLDLETLTDILQHQIRAVPFENLNIHCGDAMDLGLEAIFDQVVRRNRGGWCLQVNHLLYWALTTIGFETTMLGGYVYSTPAKKYSTGMIHLLLQVTIDGRNYIVDAGFGRSYQMWQPLELISGKDQPQVPCVFRLTEENGFWYLDQIRREQYIPNEEFLHSDLLEDSKYRKIYSFTLKPRTIEDFESMNTYLQTSPSSVFTSKSFCSLQTPDGVHCLVGFTLTHRRFNYKDNTDLIEFKTLSEEEIEKVLKNIFNISLQRKLVPKHGDRFFTI

SEQ ID NO: 818191 - protein, 69 aa, Homo sapiens
MLLLLLHKEAALEPQGPAVGYNSLPVSDDHHVSGIQARKKQQSVFWIKTEDQPTFNLLRKVLSAFLRAL

SEQ ID NO: 818192 - protein, 290 aa, Homo sapiens; identical to SEQ ID NO: 818190

SEQ ID NO: 818193 - protein, 290 aa, Homo sapiens; identical to SEQ ID NO: 818190

SEQ ID NO: 818194 - protein, 320 aa, Homo sapiens
ELVWCANTESAESRTSLDKLRSTTSLLEGIMDIEAYLERIGYKKSRNKLDLETLTDILQHQIRAVPFENLNIHCGDAMDLGLEAIFDQVVRRNRGGWCLQVNHLLYWALTTIGFETTMLGGYVYSTPAKKYSTGMIHLLLQVTIDGRNYIVDAGFGRSYQMWQPLELISGKDQPQVPCVFRLTEENGFWYLDQIRREQYIPNEEFLHSDLLEDSKYRKIYSFTLKPRTIEDFESMNTYLQTSPSSVFTSKSFCSLQTPDGVHCLVGFTLTHRRFNYKDNTDLIEFKTLSEEEIEKVLKNIFNISLQRKLVPKHGDRFFTI

SEQ ID NO: 818195 - protein, 290 aa, Homo sapiens; identical to SEQ ID NO: 818190

SEQ ID NO: 818196 - protein, 291 aa, Homo sapiens
MDIEAYLERIGYKKSRNKLDLETLTDILQHQIRAVPFENLNIHCGDAMDLGLEAIFDQVVRRNRGGWCLQVNHLLYWALTTIGFETTMLGGYVYSTPAKKYSTGMIHLLLQVTIDGRNYIVDAGFGRSYQMWQPLELISGKDQPQVPCVFRLTEENGFWYLDQIRREQYIPNEEFLHSDLLEDSKYRKIYSFTLKPRTIEDFESMNTYLQTSPSSVFTSKSFCSLQTPDGVHCLVGFTLTHRRFNYKDNTDLIEFKTLSEEEIEKVLKNIFNISLQRKLVPKHDRSSVDNW

SEQ ID NO: 818197 - protein, 175 aa, Homo sapiens
MDIEAYLERIGYKKSRNKLDLETLTDILQHQIRAVPFENLNIHCGDAMDLGLEAIFDQVVRRNRGGWCLQVNHLLYWALTTIGFETTMLGGYVYSTPAKKYSTGMIHLLLQVTIDGRNYIVDAGFGRSYQMWQPLELISGKDQPQVPCVFRLTEENGCGTKPPPPLPYLHPRCAS

SEQ ID NO: 818198 - protein, 509 aa, Homo sapiens
MEFSGRKWRKLRLAGDQRNASYPHCLQFYLQPPSENISLIEFENLAIDRVKLLKSVENLGVSYVKGTEQYQSKLESELRKLKFSYRENLEDEYEPRRRDHISHFILRLAYCQSEELRRWFIQQEMDLLRFRFSILPKDKIQDFLKDSQLQFEAISDEEKTLREQEIVASSPSLSGLKLGFESIYKIPFADALDLFRGRKVYLEDGFAYVPLKDIVAIILNEFRAKLSKALALTARSLPAVQSDERLQPLLNHLSHSYTGQDYSTQGNVGKISLDQIDLLSTKSFPPCMRQLHKALRENHHLRHGGRMQYGLFLKGIGLTLEQALQFWKQEFIKGKMDPDKFDKGYSYNIRHSFGKEGKRTDYTPFSCLKIILSNPPSQGDYHGCPFRHSDPELLKQKLQSYKISPGGISQILDLVKGTHYQVACQKYFEMIHNVDDCGFSLNHPNQFFCESQRILNGGKDIKKEPIQPETPQPKPSVQKTKDASSALASLNSSLEMDMEGLEDYFSEDS

SEQ ID NO: 818199 - protein, 240 aa, Homo sapiens
MEFSGRKWRKLRLAGDQRNASYPHCLQFYLQPPSENISLIEFENLAIDRVKLLKSVENLGVSYVKGTEQYQSKLESELRKLKFSYRENLEDEYEPRRRDHISHFILRLAYCQSEELRRWFIQQEMDLLRFRFSILPKDKIQDFLKDSQLQFEAISDEEKTLREQEIVASSPSLSGLKLGFESIYKIPFADALDLFRGRKVYLEDGFAYVPLKDIVAIILNEFRAKLSKALAVSILLDFCI

SEQ ID NO: 818200 - protein, 158 aa, Homo sapiens
MEFSGRKWRKLRLAGDQRNASYPHCLQFYLQPPSENISLIEFENLAIDRVKLLKSVENLGVSYVKGTEQYQSKLESELRKLKFSYRENLEDEYEPRRRDHISHFILRLAYCQSEELRRWFIQQEMDLLRFRFSILPKDKIQDFLKDSQLQFEAVSIFL

SEQ ID NO: 818201 - protein, 158 aa, Homo sapiens; identical to SEQ ID NO: 818200

SEQ ID NO: 818202 - protein, 222 aa, Homo sapiens
MRQLHKALRENHHLRHGGRMQYGLFLKGIGLTLEQALQFWKQEFIKGKMDPDKFDKGYSYNIRHSFGKEGKRTDYTPFSCLKIILSNPPSQGDYHGCPFRHSDPELLKQKLQSYKISPGGISQILDLVKGTHYQVACQKYFEMIHNVDDCGFSLNHPNQFFCESQRILNGGKDIKKEPIQPETPQPKPSVQKTKDASSALASLNSSLEMDMEGLEDYFSEDS

SEQ ID NO: 818203 - protein, 563 aa, Homo sapiens
ALHALTGVWPSPGRPFPSRDLGQAKSRTFGQTGDAAPPSLHPSFPPTRQFQVTKMEFSGRKWRKLRLAGDQRNASYPHCLQFYLQPPSENISLIEFENLAIDRVKLLKSVENLGVSYVKGTEQYQSKLESELRKLKFSYRENLEDEYEPRRRDHISHFILRLAYCQSEELRRWFIQQEMDLLRFRFSILPKDKIQDFLKDSQLQFEAISDEEKTLREQEIVASSPSLSGLKLGFESIYKIPFADALDLFRGRKVYLEDGFAYVPLKDIVAIILNEFRAKLSKALALTARSLPAVQSDERLQPLLNHLSHSYTGQDYSTQGNVGKISLDQIDLLSTKSFPPCMRQLHKALRENHHLRHGGRMQYGLFLKGIGLTLEQALQFWKQEFIKGKMDPDKFDKGYSYNIRHSFGKEGKRTDYTPFSCLKIILSNPPSQGDYHGCPFRHSDPELLKQKLQSYKISPGGISQILDLVKGTHYQVACQKYFEMIHNVDDCGFSLNHPNQFFCESQRILNGGKDIKKEPIQPETPQPKPSVQKTKDASSALASLNSSLEMDMEGLEDYFSEDS

SEQ ID NO: 818204 - protein, 509 aa, Homo sapiens; identical to SEQ ID NO: 818198

SEQ ID NO: 818205 - protein, 439 aa, Homo sapiens
MEFSGRKWRKLRLAGDQRNASYPHCLQFYLQPPSENISLIEFENLAIDRVKLLKSVENLGVSYVKGTEQYQSKLESELRKLKFSYRENLEDEYEPRRRDHISHFILRLAYCQSEELRRWFIQQEMDLLRFRFSILPKDKIQDFLKDSQLQFEAISDEEKTLREQEIVASSPSLSGLKLGFESIYKIPFADALDLFRGRKVYLEDGFAYVPLKDIVAIILNEFRAKLSKALALTARSLPAVQSDERLQPLLNHLSHSYTGQDYSTQGNVGKISLDQIDLLSTKSFPPCMRQLHKALRENHHLRHGGRMQYGLFLKGIGLTLEQALQFWKQEFIKGKMDPDKFDKGYSYNIRHSFGKEGKRTDYTPFSCLKIILSNPPSQGDYHGCPFRHSDPELLKQKLQSYKISPGGISQMRKLRFGEGKKLLRTIELIYDKARIRTYA

SEQ ID NO: 818206 - protein, 346 aa, Homo sapiens
MEFSGRKWRKLRLAGDQRNASYPHCLQFYLQPPSENISLIEFENLAIDRVKLLKSVENLGVSYVKGTEQYQSKLESELRKLKFSYRENLEDEYEPRRRDHISHFILRLAYCQSEELRRWFIQQEMDLLRFRFSILPKDKIQDFLKDSQLQFEAISDEEKTLREQEIVASSPSLSGLKLGFESIYKIPFADALDLFRGRKVYLEDGFAYVPLKDIVAIILNEFRAKLSKALALTARSLPAVQSDERLQPLLNHLSHSYTGQDYSTQGNVGKISLDQIDLLSTKSFPPCMRQLHKALRENHHLRHGGRMQYGLFLKGIGLTLEQALQFWKQEFIKGKMDPDKEEENDE

SEQ ID NO: 818207 - protein, 245 aa, Homo sapiens
MEFSGRKWRKLRLAGDQRNASYPHCLQFYLQPPSENISLIEFENLAIDRVKLLKSVENLGVSYVKGTEQYQSKLESELRKLKFSYRENLEDEYEPRRRDHISHFILRLAYCQSEELRRWFIQQEMDLLRFRFSILPKDKIQDFLKDSQLQFEAISDEEKTLREQEIVASSPSLSGLKLGFESIYKIPFADALDLFRGRKVYLEDGFAYVPLKDIVAIILNEFRAKLSKALAIWSLAMLPRLVLNS

SEQ ID NO: 818208 - protein, 686 aa, Homo sapiens
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQALQDWNSRGDRTVLVIAHRLQTVQRAHQILVLQEGKLQKLAQL

SEQ ID NO: 818209 - protein, 686 aa, Homo sapiens; identical to SEQ ID NO: 818208

SEQ ID NO: 818210 - protein, 653 aa, Homo sapiens
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQAKTLWKFMIF

SEQ ID NO: 818211 - protein, 217 aa, Homo sapiens
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWSEN

SEQ ID NO: 818212 - protein, 295 aa, Homo sapiens
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRKMLSGIAAFLLGLIFLLVGSPPVGLEGFWAPLRDGVKEVAPCRARRFSAQKEWPGKTPDVETSLGPLVETPT

SEQ ID NO: 818213 - protein, 114 aa, Homo sapiens
KRLTILLSHFFPFSRMGSGWVPWVVALLVNLTRLDSSMTQGTDSPGKNRAIVFFQCVCKNWHGGVMPFFVSPGHRPDWKWLLVSKNSVLPFGRKVRLASLHGMDFIYQSHLFKG

SEQ ID NO: 818214 - protein, 686 aa, Homo sapiens; identical to SEQ ID NO: 818208

SEQ ID NO: 818215 - protein, 686 aa, Homo sapiens; identical to SEQ ID NO: 818208

SEQ ID NO: 818216 - protein, 247 aa, Homo sapiens
MVTQLRYESFCLHQFQEQDGESIPENQELASKQEILKEMEHLGDSKLQRDVSLDSKYRETCKRDSKAEKQQAHSTGERRHRCNECGKSFTKSSVLIEHQRIHTGEKPYECEECGKAFSRRSSLNEHRRSHTGEKPYQCKECGKAFSASNGLTRHRRIHTGEKPYECKVCGKAFLLSSCLVQHQRIHTGEKRYQCRECGKAFIQNAGLFQHLRVHTGEKPYQCSQCSKLFSKRTLLKKHQKIHTGERP

SEQ ID NO: 818217 - protein, 406 aa, Homo sapiens
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHHPESGEEAVAVVEDLEQELSEPGNQAPDHEHGHSEVLLEDVEHLKVKQEPTDIQLQPMVTQLRYESFCLHQFQEQDGESIPENQELASKQEILKEMEHLGDSKLQRDVSLDSKYRETCKRDSKAEKQQAHSTGERRHRCNECGKSFTKSSVLIEHQRIHTGEKPYECEECGKAFSRRSSLNEHRRSHTGEKPYQCKECGKAFSASNGLTRHRRIHTGEKPYECKVCGKAFLLSSCLVQHQRIHTGEKRYQCRECGKAFIQNAGLFQHLRVHTGEKPYQCSQCSKLFSKRTLLKKHQKIHTGERP

SEQ ID NO: 818218 - protein, 406 aa, Homo sapiens; identical to SEQ ID NO: 818217

SEQ ID NO: 818219 - protein, 406 aa, Homo sapiens; identical to SEQ ID NO: 818217

SEQ ID NO: 818220 - protein, 247 aa, Homo sapiens; identical to SEQ ID NO: 818216

SEQ ID NO: 818221 - protein, 247 aa, Homo sapiens; identical to SEQ ID NO: 818216

SEQ ID NO: 818222 - protein, 218 aa, Homo sapiens
MVTQLRYESFCLHQFQEQDGESIPENQELASKQEILKEMEHLGDSKLQRDVSLDSKYRETCKRDSKAEKQQAHSTGERRHRCNECGKSFTKSSVLIEHQRIHTGEKPYECEECGKAFSRRSSLNEHRRSHTGEKPYQCKECGKAFSASNGLTRHRRIHTGEKPYECKVCGKAFLLSSCLVQHQRIHTGEKRYQCRECGKAFIQNAGLFQHLRVHTVKT

SEQ ID NO: 818223 - protein, 299 aa, Homo sapiens
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHHPESGEEAVAVVEDLEQELSEPGNQAPDHEHGHSEVLLEDVEHLKVKQEPTDIQLQPMVTQLRYESFCLHQFQEQDGESIPENQELASKQEILKEMEHLGDSKLQRDVSLDSKYRETCKRDSKAEKQQAHSTGERRHRCNECGKSFTKSSVLIEHQRIHTGEKPYECEECGKAFSRRSSLNEHRRSHTGEKPYQFKT

SEQ ID NO: 818224 - protein, 366 aa, Homo sapiens
MQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 818225 - protein, 318 aa, Homo sapiens
TERRGTPGAWVPSMILGSLSRAGPLPLLRQPPIMQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 818226 - protein, 107 aa, Homo sapiens
MENEPSIGVSHPACGSWTTSGSGPGHESMHVVTGWGLLVPCPPGNGGGLFHMKSLLQEPSRVIPMFLPQQQFPWRMDWGQPQDPQRNSGHQDMMAAVRSVVQGITKE

SEQ ID NO: 818227 - protein, 382 aa, Homo sapiens
AGPHSPEPPGQRAPRPWPARPGQARPPSPGPPPRAMEPRPPGSRRMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 818228 - protein, 399 aa, Homo sapiens
TERRGTPGAWVPSMILGSLSRAGPLPLLRQPPIMQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 818229 - protein, 366 aa, Homo sapiens; identical to SEQ ID NO: 818224

SEQ ID NO: 818230 - protein, 399 aa, Homo sapiens
SRGSVYTMCTEGDTSECSLSRAGPLPLLRQPPIMQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 818231 - protein, 415 aa, Homo sapiens
RAEPREGDAVRPRPLGGQGQATAWGQQASETKGSLSRAGPLPLLRQPPIMQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 818232 - protein, 244 aa, Homo sapiens [sequence omitted]

SEQ ID NO: 818233 - protein, 412 aa, Homo sapiens
MQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPESHSVAQARVQWHNLSSLQPPPPRFKRFSCLSLLSSWDYRHLPPHPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 818234 - protein, 366 aa, Homo sapiens; identical to SEQ ID NO: 818224

SEQ ID NO: 818235 - protein, 366 aa, Homo sapiens; identical to SEQ ID NO: 818224

SEQ ID NO: 818236 - protein, 70 aa, Homo sapiens
KHKTILEARSGLGPIKAYPRLGPPTPGEPEAPAQDRTFHCEICNVKVNSEVQLKQVGLRPFPGILGRSTR

SEQ ID NO: 818237 - protein, 174 aa, Homo sapiens
MSNGYRTLSQHLNDLKKENFSLKLLIYFLEERMQQKYEASREDIYKRNTELKVEVESLKRELQDKKQHLDKTWADVENLNSQNEAELRRQFEERQQETEHVYELLENKMQLLQEESRLAKNEAARMAALVEAEKECNLELSEKLKGVTKNWEDVPGDQVKPDQYTEALAQRDKI

SEQ ID NO: 818238 - protein, 174 aa, Homo sapiens; identical to SEQ ID NO: 818237

SEQ ID NO: 818239 - protein, 240 aa, Homo sapiens
MEQTWTRDYFAEDDGEMVPRTSHTAAFLSDTKDRGPPVQSQIWRSGEKVPFVQTYSLRAFEKPPQVQTQALRDFEKHLNDLKKENFSLKLLIYFLEERMQQKYEASREDIYKRNTELKVEVESLKRELQDKKQHLDKTWADVENLNSQNEAELRRQFEERQQETEHVYELLENKMQLLQEESRLAKNEAARMAALVEAEKECNLELSEKLKGVTKNWEDVPGDQVKPDQYTEALAQRDKI

SEQ ID NO: 818240 - protein, 142 aa, Homo sapiens
MQQKYEASREDIYKRNTELKVEVESLKRELQDKKQHLDKTWADVENLNSQNEAELRRQFEERQQETEHVYELLENKMQLLQEESRLAKNEAARMAALVEAEKECNLELSEKLKGVTKNWEDVPGDQVKPDQYTEALAQRDKI

SEQ ID NO: 818241 - protein, 185 aa, Homo sapiens
MSNGYRTLSQHLNDLKKENFSLKLLIYFLEERMQQKYEASREDIYKRNTELKVEVESLKRELQDKKQHLDKTWADVENLNSQNEAELRRQFEERQQETEHVYELLENKMQLLQEESRLAKNEAARMAALVEAEKECNLELSEKLKGVTKNWEDVPGDQVKPDQYTEALAQRDNPSTDSLKNFRLF

SEQ ID NO: 818242 - protein, 174 aa, Homo sapiens; identical to SEQ ID NO: 818237

SEQ ID NO: 818243 - protein, 185 aa, Homo sapiens; identical to SEQ ID NO: 818241

SEQ ID NO: 818244 - protein, 141 aa, Homo sapiens
MSNGYRTLSQHLNDLKKENFSLKLLIYFLEERMQQKYEASREDIYKRNTELKVEVESLKRELQDKKQHLDKTWADVENLNSQNEAELRRQFEERQQETEHVYELLENKMQLLQEESRLAKNEAARMAAPGSTPSLLPPELV

SEQ ID NO: 818245 - protein, 112 aa, Homo sapiens
MRPAGRTSTSGADVENLNSQNEAELRRQFEERQQETEHVYELLENKMQLLQEESRLAKNEAARMAALVEAEKECNLELSEKLKGVTKNWEDVPGDQVKPDQYTEALAQRDKI

SEQ ID NO: 818246 - protein, 214 aa, Homo sapiens
MSNGYRTLSQHLNDLKKENFSLKLLIYFLEERMQQKYEASREDIYKRNTELKVEVESLKRELQDKKQHLDKTWADVENLNSQNEAELRRQFEERQQETEHVYELLENKMQLLQEESRLAKNEAARMAALVEAEKECNLELSEKLKGVTKNWEDVPGDQVKPDQYTEALAQRDKSRFLHSGKEENVPILGKTSFRWHSFDQTAKFYPSMYCHLTV

SEQ ID NO: 818247 - protein, 391 aa, Homo sapiens
MEPLRVLELYSGVGGMHHALRESCIPAQVVAAIDVNTVANEVYKYNFPHTQLLAKTIEGITLEEFDRLSFDMILMSPPCQPFTRIGRQGDMTDSRTNSFLHILDILPRLQKLPKYILLENVKGFEVSSTRDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFGFPEKITVKQRYRLLGNSLNVHVVAKLIKILYE

SEQ ID NO: 818248 - protein, 391 aa, Homo sapiens; identical to SEQ ID NO: 818247

SEQ ID NO: 818249 - protein, 367 aa, Homo sapiens
MEPLRVLELYSGVGGMHHALRESCIPAQVVAAIDVNTVANEVYKYNFPHTQLLAKTIEGITLEEFDRLSFDMILMSPPCQPFTRLQKLPKYILLENVKGFEVSSTRDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFGFPEKITVKQRYRLLGNSLNVHVVAKLIKILYE

SEQ ID NO: 818250 - protein, 345 aa, Homo sapiens
MEPLRVLELYSGVGGMHHALRESCIPAQVVAAIDVNTVANEVYKYNFPHTQLLAKTIEGITLEEFDRLSFDMILMSPPCQPFTRDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFGFPEKITVKQRYRLLGNSLNVHVVAKLIKILYE

SEQ ID NO: 818251 - protein, 308 aa, Homo sapiens
MSTLSLMKYTSIIFLTHSYLPRRLKLQKLPKYILLENVKGFEVSSTRDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFGFPEKITVKQRYRLLGNSLNVHVVAKLIKILYE

SEQ ID NO: 818252 - protein, 310 aa, Homo sapiens
MSTLSLMKYTSIIFLTHSYLPRRLKIGRQGDMTDSRTNSFLHILDILPRDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFGFPEKITVKQRYRLLGNSLNVHVVAKLIKILYE

SEQ ID NO: 818253 - protein, 286 aa, Homo sapiens
MSTLSLMKYTSIIFLTHSYLPRRLKDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFGFPEKITVKQRYRLLGNSLNVHVVAKLIKILYE

SEQ ID NO: 818254 - protein, 377 aa, Homo sapiens
MEPLRVLELYSGVGGMHHALRESCIPAQVVAAIDVNTVANEVYKYNFPHTQLLAKTIEGITLEEFDRLSFDMILMSPPCQPFTRIGRQGDMTDSRTNSFLHILDILPRLQKLPKYILLENVKGFEVSSTRDLLIQTIENCGFQYQEFLLSPTSLGIPNSRLRYFLIAKLQSEPLPFQAPGQVLMEFPKIESVHPQKYAMDVENKIQEKNVEPNISFDGSIQCSGKDAILFKLETAEEIHRKNQQDSDLSVKMLKDFLEDDTDVNQYLLPPKSLLRYALLLDIVQPTCRRSVCFTKGYGSYIEGTGSVLQTAEDVQVENIYKSLTNLSQEEQITKLLILKLRYFTPKEIANLLGFPPEFDEQSDILLKTEKRLTIQLK

SEQ ID NO: 818255 - protein, 385 aa, Homo sapiens
SLSGCVCCRHCAALVPSEGSCCCRCLGPSPSLLVLLPQEPGGSGTPVRAGAGAGMWLWEDQGGLLGPFSFLLLVLLLVTRSPVNACLLTGSLFVLLRVFSFEPVPSCRALQVLKPRDRISAIAHRGGSHDAPENTLAAIRQAAKNGATGVELDIEFTSDGIPVLMHDNTVDRTTDGTGRLCDLTFEQIRKLNPAANHRLRNDFPDEKIPTLREAVAECLNHNLTIFFDVKGHAHKATEALKKMYMEFPQLYNNSVVCSFLPEVIYKMRQTDRDVITALTHRPWSLSHTGDGKPRYDTFWKHFIFVMMDILLDWSMHNILWYLCGISAFLMQKDFVSPAYLKKWSAKGIQVVGWTVNTFDEKSYYESHLGSSYITDSMVEDCEPHF

SEQ ID NO: 818256 - protein, 385 aa, Homo sapiens; identical to SEQ ID NO: 818255

SEQ ID NO: 818257 - protein, 385 aa, Homo sapiens; identical to SEQ ID NO: 818255

SEQ ID NO: 818258 - protein, 385 aa, Homo sapiens; identical to SEQ ID NO: 818255

SEQ ID NO: 818259 - protein, 385 aa, Homo sapiens; identical to SEQ ID NO: 818255

SEQ ID NO: 818260 - protein, 385 aa, Homo sapiens; identical to SEQ ID NO: 818255

SEQ ID NO: 818261 - protein, 385 aa, Homo sapiens; identical to SEQ ID NO: 818255

SEQ ID NO: 818262 - protein, 385 aa, Homo sapiens; identical to SEQ ID NO: 818255

SEQ ID NO: 818263 - protein, 380 aa, Homo sapiens
GLVEPGWLIGRGEGSCCCRCLGPSPSLLVLLPQEPGGSGTPVRAGAGAGMWLWEDQGGLLGPFSFLLLVLLLVTRSPVNACLLTGSLFVLLRVFSFEPVPSCRALQVLKPRDRISAIAHRGGSHDAPENTLAAIRQAAKNGATGVELDIEFTSDGIPVLMHDNTVDRTTDGTGRLCDLTFEQIRKLNPAANHRLRNDFPDEKIPTLREAVAECLNHNLTIFFDVKGHAHKATEALKKMYMEFPQLYNNSVVCSFLPEVIYKMRQTDRDVITALTHRPWSLSHTGDGKPRYDTFWKHFIFVMMDILLDWSMHNILWYLCGISAFLMQKDFVSPAYLKKWSAKGIQVVGWTVNTFDEKSYYESHLGSSYITDSMVEDCEPHF

SEQ ID NO: 818264 - protein, 385 aa, Homo sapiens; identical to SEQ ID NO: 818255

SEQ ID NO: 818265 - protein, 385 aa, Homo sapiens; identical to SEQ ID NO: 818255

SEQ ID NO: 818266 - protein, 385 aa, Homo sapiens; identical to SEQ ID NO: 818255

SEQ ID NO: 818267 - protein, 385 aa, Homo sapiens; identical to SEQ ID NO: 818255

SEQ ID NO: 818268 - protein, 354 aa, Homo sapiens
SLSGCVCCRHCAALVPSEGSCCCRCLGPSPSLLVLLPQEPGGSGTPVRAGAGAGMWLWEDQGGLLGPFSFLLLVLLLVTRSPVNACLLTGSLFVLLRVFSFEPVPSCRALQVLKPRDRISAIAHRGGSHDAPENTLAAIRQAAKNGATGVELDIEFTSDGIPVLMHDNTVDRTTDGTGRLCDLTFEQIRKLNPAANHRLRNDFPDEKIPTLREAVAECLNHNLTIFFDVKGHAHKMRQTDRDVITALTHRPWSLSHTGDGKPRYDTFWKHFIFVMMDILLDWSMHNILWYLCGISAFLMQKDFVSPAYLKKWSAKGIQVVGWTVNTFDEKSYYESHLGSSYITDSMVEDCEPHF

SEQ ID NO: 818269 - protein, 276 aa, Homo sapiens
MEKRSSLLLRSVSICRGGSHDAPENTLAAIRQAAKNGATGVELDIEFTSDGIPVLMHDNTVDRTTDGTGRLCDLTFEQIRKLNPAANHRLRNDFPDEKIPTLREAVAECLNHNLTIFFDVKGHAHKATEALKKMYMEFPQLYNNSVVCSFLPEVIYKMRQTDRDVITALTHRPWSLSHTGDGKPRYDTFWKHFIFVMMDILLDWSMHNILWYLCGISAFLMQKDFVSPAYLKKWSAKGIQVVGWTVNTFDEKSYYESHLGSSYITDSMVEDCEPHF

SEQ ID NO: 818270 - protein, 221 aa, Homo sapiens
MHDNTVDRTTDGTGRLCDLTFEQIRKLNPAANHRLRNDFPDEKIPTLREAVAECLNHNLTIFFDVKGHAHKATEALKKMYMEFPQLYNNSVVCSFLPEVIYKMRQTDRDVITALTHRPWSLSHTGDGKPRYDTFWKHFIFVMMDILLDWSMHNILWYLCGISAFLMQKDFVSPAYLKKWSAKGIQVVGWTVNTFDEKSYYESHLGSSYITDSMVEDCEPHF

SEQ ID NO: 818271 - protein, 277 aa, Homo sapiens
SLSGCVCCRHCAALVPSEGSCCCRCLGPSPSLLVLLPQEPGGSGTPVRAGAGAGMWLWEDQGGLLGPFSFLLLVLLLVTRSPVNACLLTGSLFVLLRVFSFEPVPSCRALQVLKPRDRISAIAHRGGSHDAPENTLAAIRQAAKNGATGVELDIEFTSDGIPVLMHDNTVDRTTDGTGRLCDLTFEQIRKLNPAANHRLRNDFPDEKIPTLREAVAECLNHNLTIFFDVKGHAHKATEALKKMYMEFPQLYNNSVVCSFLPEVIYKMSIMLRNYQKA

SEQ ID NO: 818272 - protein, 112 aa, Homo sapiens
MYHIVARSLEATMRKIGQEMCTCPPRSPSPILCALQGFRSESRVGDEKGNLCRLSLSLWSARVSRKKRYEHCEASAALHAGDLGSLCREVRVQHPCPGVVVQDLQGRVALFL

SEQ ID NO: 818273 - protein, 121 aa, Homo sapiens
PALHSQVFPALTPKRWTQVRRGTATVGGMAILQVTAGHPLAMAQGPAGHPPTMVQGPAGHPLAMAQGPAGHPPTMVQGPAGLPLAMAQVTHPLVHITEEVEENRTQDGKPERIAQLTWNEA

SEQ ID NO: 818274 - protein, 128 aa, Homo sapiens
GKWSEGELIQVSLALTSDSDIVHLTFHRGTATVGGMAILQVTAGHPLAMAQGPAGHPPTMVQGPAGHPLAMAQGPAGHPPTMVQGPAGLPLAMAQVTHPLVHITEEVEENRTQDGKPERIAQLTWNEA

SEQ ID NO: 818275 - protein, 101 aa, Homo sapiens
KNSARGSQVFPALTPKRWTQVRRGTATVGGMAILQVTAGHPLAMAQGPAGHPPTMVQGPAGLPLAMAQVTHPLVHITEEVEENRTQDGKPERIAQLTWNEA

SEQ ID NO: 818276 - protein, 305 aa, Homo sapiens
MAPLDLDKYVEIARLCKYLPENDLKRLCDYVCDLLLEESNVQPVSTPVTVCGDIHGQFYDLCELFRTGGQVPDTNYIFMGDFVDRGYYSLETFTYLLALKAKWPDRITLLRGNHESRQITQVYGFYDECQTKYGNANAWRYCTKVFDMLTVAALIDEQILCVHGGLSPDIKTLDQIRTIERNQEIPHKGAFCDLVWSDPEDVDTWAISPRGAGWLFGAKVTNEFVHINNLKLICRAHQLVHEGYKFMFDEKLVTVWSAPNYCYRCGNIASIMVFKDVNTREPKLFRAVPDSERVIPPRTTTPYFL

SEQ ID NO: 818277 - protein, 110 aa, Homo sapiens
MAPLDLDKYVEIARLCKYLPENDLKRLCDYVCDLLLEESNVQPVSTPVTVCGDIHGQFYDLCELFRTGGQVPDTNYIFMSLFQYIKRCVLVRFHAADKDIPETGQFTKEV

SEQ ID NO: 818278 - protein, 305 aa, Homo sapiens; identical to SEQ ID NO: 818276

SEQ ID NO: 818279 - protein, 305 aa, Homo sapiens; identical to SEQ ID NO: 818276

SEQ ID NO: 818280 - protein, 305 aa, Homo sapiens; identical to SEQ ID NO: 818276

SEQ ID NO: 818281 - protein, 305 aa, Homo sapiens; identical to SEQ ID NO: 818276

SEQ ID NO: 818282 - protein, 305 aa, Homo sapiens; identical to SEQ ID NO: 818276

SEQ ID NO: 818283 - protein, 305 aa, Homo sapiens; identical to SEQ ID NO: 818276

SEQ ID NO: 818284 - protein, 305 aa, Homo sapiens; identical to SEQ ID NO: 818276

SEQ ID NO: 818285 - protein, 305 aa, Homo sapiens; identical to SEQ ID NO: 818276

SEQ ID NO: 818286 - protein, 335 aa, Homo sapiens
SDHAFAARGHSVNDPAQYLVTYVILVLISACLLQQMNLEARGMYTELFVTLIILNRSPCSVMSHDLLIQVEQSVCEHLPIGTFTASPFYDLCELFRTGGQVPDTNYIFMGDFVDRGYYSLETFTYLLALKAKWPDRITLLRGNHESRQITQVYGFYDECQTKYGNANAWRYCTKVFDMLTVAALIDEQILCVHGGLSPDIKTLDQIRTIERNQEIPHKGAFCDLVWSDPEDVDTWAISPRGAGWLFGAKVTNEFVHINNLKLICRAHQLVHEGYKFMFDEKLVTVWSAPNYCYRCGNIASIMVFKDVNTREPKLFRAVPDSERVIPPRTTTPYFL

SEQ ID NO: 818287 - protein, 158 aa, Homo sapiens
MLTVAALIDEQILCVHGGLSPDIKTLDQIRTIERNQEIPHKGAFCDLVWSDPEDVDTWAISPRGAGWLFGAKVTNEFVHINNLKLICRAHQLVHEGYKFMFDEKLVTVWSAPNYCYRCGNIASIMVFKDVNTREPKLFRAVPDSERVIPPRTTTPYFL

SEQ ID NO: 818288 - protein, 305 aa, Homo sapiens; identical to SEQ ID NO: 818276

SEQ ID NO: 818289 - protein, 231 aa, Homo sapiens
MAPLDLDKYVEIARLCKYLPENDLKRLCDYVCDLLLEESNVQPVSTPVTVCGDIHGQFYDLCELFRTGGQVPDTNYIFMGDFVDRGYYSLETFTYLLALKAKWPDRITLLRGNHESRQITQVYGFYDECQTKYGNANAWRYCTKVFDMLTVAALIDEQILCVHGGLSPDIKTLDQIRTIERNQEIPHKGAFCDLVWSDPEDVDTWAISPRGAGWLFGAKVTNEVKPTFLEM

SEQ ID NO: 818290 - protein, 267 aa, Homo sapiens
MAVPETRPNHTIYINNLNEKIKKDELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGFKEVRLVPGRHDIAFVEFDNEVQAGAARGCPAGL

SEQ ID NO: 818291 - protein, 267 aa, Homo sapiens; identical to SEQ ID NO: 818290

SEQ ID NO: 818292 - protein, 262 aa, Homo sapiens
MAVPETRPNHTIYINNLNEKIKKDELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGFKEVRLVPGRHDIAFVEFDNEVQAGAAGA

SEQ ID NO: 818293 - protein, 184 aa, Homo sapiens [sequence omitted]

SEQ ID NO: 818294 - protein, 227 aa, Homo sapiens
RDAYRLVTFTDWSVDPGATEGELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQ

SEQ ID NO: 818295 - protein, 267 aa, Homo sapiens; identical to SEQ ID NO: 818290

SEQ ID NO: 818296 - protein, 267 aa, Homo sapiens; identical to SEQ ID NO: 818290

SEQ ID NO: 818297 - protein, 267 aa, Homo sapiens; identical to SEQ ID NO: 818290

SEQ ID NO: 818298 - protein, 267 aa, Homo sapiens; identical to SEQ ID NO: 818290

SEQ ID NO: 818299 - protein, 230 aa, Homo sapiens [sequence omitted]

SEQ ID NO: 818300 - protein, 267 aa, Homo sapiens; identical to SEQ ID NO: 818290

SEQ ID NO: 818301 - protein, 267 aa, Homo sapiens; identical to SEQ ID NO: 818290

SEQ ID NO: 818302 - protein, 229 aa, Homo sapiens
MAVPETRPNHTIYINNLNEKIKKDELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPCSFLDPDHCLHCRDKVWASSRLVRGLVGG

SEQ ID NO: 818303 - protein, 347 aa, Homo sapiens
MFASASQNNRGSYSHVWIDRSLASAPSTRTHRVGMHLLCRSEESCEPTTLDDGSRRIPGLTVTVYVLSVYKTLPPWSSLSMAVPETRPNHTIYINNLNEKIKKDELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGFKEVRLVPGRHDIAFVEFDNEVQAGAARGCPAGL

SEQ ID NO: 818304 - protein, 279 aa, Homo sapiens
RHNKIENQANTFLFKLLQLTAVPHRTHYFSTNESEGELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGFKEVRLVPGRHDIAFVEFDNEVQAGAARGCPAGL

SEQ ID NO: 818305 - protein, 279 aa, Homo sapiens
MDPRHSGYPINWLMVFYLGCASSKKGSSKVFFSPTAELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGFKEVRLVPGRHDIAFVEFDNEVQAGAARGCPAGL

SEQ ID NO: 818306 - protein, 246 aa, Homo sapiens
MAVPETRPNHTIYINNLNEKIKKDELKKSLYAIFSQFGQILDILVSRSLKMRGQAFVIFKERIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGFKEVRLVPGRHDIAFVEFDNEVQAGAARGCPAGL

SEQ ID NO: 818307 - protein, 165 aa, Homo sapiens
ARGFVVWSQGSSRRRLRELRPCRKVTSGANDHRRQASGTLGVRAFLGPSEETCCSRPGCLGPVPFFYTGSHIRVFSPGRPFGCLGQWESPFRVLRPPGRVEHPGSRSKSLESSLRTRAGEAGPTHALLSRFASVLPPTPALPDFLFGGRSLSSRRWDKGFGETQG

SEQ ID NO: 818308 - protein, 120 aa, Homo sapiens
MAVPETRPNHTIYINNLNEKIKKDELKKSLYAIFSQFGQILDILVSRSLKMRGQAFVIFKEVSSATNLPEETNELMLSMLFNQFPGFKEVRLVPGRHDIAFVEFDNEVQAGAARGCPAGL

SEQ ID NO: 818309 - protein, 82 aa, Homo sapiens
GLRALVLTDSPIPPQLSENPPNHILFLTNLPEETNELMLSMLFNQFPGFKEVRLVPGRHDIAFVEFDNEVQAGAARGCPAGL

SEQ ID NO: 818310 - protein, 165 aa, Homo sapiens; identical to SEQ ID NO: 818307

SEQ ID NO: 818311 - protein, 75 aa, Homo sapiens
NLEDPRYNAKAINELMLSMLSISSLASRRSVWYPGGMTSPSWSLTMRYRQGQLADALQGFKITQNNAMKISFAKK

SEQ ID NO: 818312 - protein, 561 aa, Homo sapiens
GAANGPAPLGVRAPPAWRTSPAAEMGATGAAEPLQSVLWVKQQRCAVSLEPARALLRWWRSPGPGAGAPGADACSVPVSEIIAVEETDVHGKHQGSGKWQKMEKPYAFTVHCVKRARRHRWKWAQVTFWCPEEQLCHLWLQTLREMLEKLTSRPKHLLVFINPFGGKGQGKRIYERKVAPLFTLASITTDIIVTEHANQAKETLYEINIDKYDGIVCVGGDGMFSEVLHGLIGRTQRSAGVDQNHPRAVLVPSSLRIGIIPAGSTDCVCYSTVGTSDAETSALHIVVGDSLAMDVSSVHHNSTLLRYSVSLLGYGFYGDIIKDSEKKRWLGLARYDFSGLKTFLSHHCYEGTVSFLPAQHTVGSPRDRKPCRAGCFVCRQSKQQLEEEQKKALYGLEAAEDVEEWQVVCGKFLAINATNMSCACRRSPRGLSPAAHLGDGSSDLILIRKCSRFNFLRFLIRHTNQQDQFDFTFVEVYRVKKFQFTSKHMEDEDSDLKEGGKKRFGHICSSHPSCCCTVSNSSWNCDGEVLHSPAIEVRVHCQLVRLFARGIEENPKPDSHS

SEQ ID NO: 818313 - protein, 111 aa, Homo sapiens
KDDIADRFIAVRGISWTEFDFTFVEVYRVKKFQFTSKHMEDEDSDLKEGGKKRFGHICSSHPSCCCTVSNSSWNCDGEVLHSPAIEVRVHCQLVRLFARGIEENPKPDSHS

SEQ ID NO: 818314 - protein, 561 aa, Homo sapiens; identical to SEQ ID NO: 818312

SEQ ID NO: 818315 - protein, 561 aa, Homo sapiens; identical to SEQ ID NO: 818312

SEQ ID NO: 818316 - protein, 171 aa, Homo sapiens
GAANGPAPLGVRAPPAWRTSPAAEMGATGAAEPLQSVLWVKQQRCAVSLEPARALLRWWRSPGPGAGAPGADACSVPVSEIIAVEETDVHGKHQGSGKWQKMEKPYAFTVHCVKRARRHRWKWAQVTFWCPEEQLCHLWLQTLREMLEKLSTCVFGLRDRMAVVACACLIG

SEQ ID NO: 818317 - protein, 182 aa, Homo sapiens
MKTLAGLVLGLVIFDAAVTAPTLESINYDSETYDATLEDLDNLYNYENIPVDKVEIEIATVMPSGNRELLTPPPQPEKAQEEEEEEESTPRLIDGSSPQEPEFTGVLGPHTNEDFPTCLLCTCISTTVYCDDHELDAIPPLPKNTAYFYSRFNRIKKINKNDFASLSMDDSINGLHRFTHFL

SEQ ID NO: 818318 - protein, 322 aa, Homo sapiens
MKTLAGLVLGLVIFDAAVTAPTLESINYDSETYDATLEDLDNLYNYENIPVDKVEIEIATVMPSGNRELLTPPPQPEKAQEEEEEEESTPRLIDGSSPQEPEFTGVLGPHTNEDFPTCLLCTCISTTVYCDDHELDAIPPLPKNTAYFYSRFNRIKKINKNDFASLSDLKRIDLTSNLISEIDEDAFRKLPQLRELVLRDNKIRQLPELPTTLTFIDISNNRLGRKGIKQEAFKDMYDLHHLYLTDNNLDHIPLPLPENLRALHLQNNNILEMHEDTFCNVKNLTYIRKALEDIRLDGNPINLSKTPQAYMCLPRLPVGSLV

SEQ ID NO: 818319 - protein, 408 aa, Homo sapiens
MLNDSQYNPKRQTLVFSATLTLVHQAPARILHKKHTKKMDKTAKLDLLMQKIGMRGKPKVIDLTRNEATVETLTETKIHCETDEKDFYLYYFLMQYPGRSLVFANSISCIKRLSGLLKVLDIMPLTLHACMHQKQRLRNLEQFARLEDCVLLATDVAARGLDIPKVQHVIHYQVPRTSEIYVHRSGRTARATNEGLSLMLIGPEDVINFKKIYKALKKDEDIPLFPVQTKYMDVVKERIRLARQIEKSEYRNFQACLHNSWIEQQQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 818320 - protein, 116 aa, Homo sapiens
MVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISHPPSSLYEP

SEQ ID NO: 818321 - protein, 81 aa, Homo sapiens
ASGDLAPQQLTAFSLLVSRSRPSSLRPSSTSCRAWDTVSMAFPVCSGSGHVSELEVLCPEPGLDEQFCVPLASFSFLGGNS

SEQ ID NO: 818322 - protein, 394 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 818323 - protein, 394 aa, Homo sapiens; identical to SEQ ID NO: 818322

SEQ ID NO: 818324 - protein, 372 aa, Homo sapiens [sequence omitted]

SEQ ID NO: 818325 - protein, 345 aa, Homo sapiens
TTYFRPWSLRRPNHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 818326 - protein, 205 aa, Homo sapiens
MVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 818327 - protein, 125 aa, Homo sapiens
FYLKAAGIKSSLGLARRRACGWWTGMPGSSPGSLLPSNRLSLVPLVPSASMTRLMRSRTASGSSVTSLDGTRSRSHTSEGTRSRSHTSEGTRSRSHTSEGAHLDITPNSGAAGNSAGPKSMEVSC

SEQ ID NO: 818328 - protein, 394 aa, Homo sapiens; identical to SEQ ID NO: 818322

SEQ ID NO: 818329 - protein, 394 aa, Homo sapiens; identical to SEQ ID NO: 818322

SEQ ID NO: 818330 - protein, 394 aa, Homo sapiens; identical to SEQ ID NO: 818322

SEQ ID NO: 818331 - protein, 394 aa, Homo sapiens; identical to SEQ ID NO: 818322

SEQ ID NO: 818332 - protein, 106 aa, Homo sapiens
LNKILFSFGEGGNSDMQAPLLNRQNRKGEKVGFMSRLNLAWLPAGAEARQFTIRPRLPRGAGPPASAPSFPFSLALGAGHRDFTWLCSRHAVWDSQGKPACHPHLP

SEQ ID NO: 818333 - protein, 394 aa, Homo sapiens; identical to SEQ ID NO: 818322

SEQ ID NO: 818334 - protein, 336 aa, Homo sapiens [sequence omitted]

SEQ ID NO: 818335 - protein, 333 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSGRLEMGEDAGTHRHLQCLLCGGGALCVMRVSALILTTRHSLRWRLCGSADLQRSLRLQYSCRMGNSEHRLMRPPALVQRILVTRVNRRTSVRGRASHTGH

SEQ ID NO: 818336 - protein, 210 aa, Homo sapiens [sequence omitted]

SEQ ID NO: 818337 - protein, 113 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGFQVA

SEQ ID NO: 818338 - protein, 130 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFG

SEQ ID NO: 818339 - protein, 109 aa, Homo sapiens
MADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 818340 - protein, 104 aa, Homo sapiens
MCFATETPNFFLILLFSLLSLTAVLQTKPATTPSSTTRTCRRSPSTLPSATWTPLASRTAQPPSPQGTCTPPWISWLKCFLESFNSLGKSEGSAPSLSAEKPGF

SEQ ID NO: 818341 - protein, 394 aa, Homo sapiens; identical to SEQ ID NO: 818322

SEQ ID NO: 818342 - protein, 394 aa, Homo sapiens; identical to SEQ ID NO: 818322

SEQ ID NO: 818343 - protein, 293 aa, Homo sapiens
MGWGRGAAACSAAHTAFFWVLLSSFGLPWKVPSVSDCWDVCLTLCLELQLNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 818344 - protein, 198 aa, Homo sapiens
MQEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 818345 - protein, 67 aa, Homo sapiens
RYRQVVCQLWSGRHSREYVHQLRQECYALNGTQRFLERYIYNLGSEFVRFDSDVVVEFRAVTGAGAA

SEQ ID NO: 818346 - protein, 394 aa, Homo sapiens; identical to SEQ ID NO: 818322

SEQ ID NO: 818347 - protein, 394 aa, Homo sapiens; identical to SEQ ID NO: 818322

SEQ ID NO: 818348 - protein, 383 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYSEYGIPRVQWVGACVGIGSAWLDEPFAHLASVLTVRFSSCSVDIPDLWVRSRGSEKYVSCGCGIDPNSF

SEQ ID NO: 818349 - protein, 216 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKPFDYQALVLDTVMCAVTSCSPSLDLVALKFLALPVPD

SEQ ID NO: 818350 - protein, 264 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKQHYWHGKQEQAPYILSSELALKQTRGDEWRGLVLIKRGTTGAGRAGMDEGRLQDLRMDPSSAGHGGVPPFWEGRNAEYVEVVHTYRQHIVNDMNPGNLHLFINAYNSRRDLEIERPMPGTHTVTVSTLPGPA

SEQ ID NO: 818351 - protein, 115 aa, Homo sapiens
LGWMGVGDFSRGGVLMLMMHLFPAAGATWRLSDQCREPTQSPCSEWLFSPPALAVGAAHYKGGLAGRAFFLSVAGHCVSETWIYSTQRLSITQPDLDFSLCRWHPFLGCPHDLGL

SEQ ID NO: 818352 - protein, 608 aa, Homo sapiens
MSDKSDLKAELERKKQRLAQIREEKKRKEEERKKKEADMQQKKEPVQDDSDLDRKRRETEALLQSIGISPEPPLVPTPMSPSSKSVSTPSEAGSQDSGDLGPLTRRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGELAVPHNDEWTRFARTLVEIRANRADSEEEGTVELSA

SEQ ID NO: 818353 - protein, 116 aa, Homo sapiens
MSDKSDLKAELERKKQRLAQIREEKKRKEEERKKKEADMQQKKEPVQDDSDLDRKRRETEALLQSIGISPEPPLVPTPMSPSSKSVSTPSEAGSQDSGDLGPLTRDEALLCSPGWS

SEQ ID NO: 818354 - protein, 625 aa, Homo sapiens
MSDKSDLKAELERKKQRLAQIREEKKRKEEERKKKEADMQQKKEPVQDDSDLDRKRRETEALLQSIGISPEPPLVQPLHFLTWDTCYFHYLVPTPMSPSSKSVSTPSEAGSQDSGDLGPLTRRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGELAVPHNDEWTRFARTLVEIRANRADSEEEGTVELSA

SEQ ID NO: 818355 - protein, 541 aa, Homo sapiens
MSDKSDLKAELERKKQRLAQIREEKKRKEEERKKKEADMQQKKEPVQDDSDLDRKRRETEALLQSIGISPEPPLVPTPMSPSSKSVSTPSEAGSQDSGDLGPLTRTLQWDTDPSVLQLQSDSELGRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKSEVTGPPINSREPGLSVYYWKCTSFVEVSGKECCGIGD

SEQ ID NO: 818356 - protein, 645 aa, Homo sapiens
MSDKSDLKAELERKKQRLAQIREEKKRKEEERKKKEADMQQKKEPVQDDSDLDRKRRETEALLQSIGISPEPPLVQPLHFLTWDTCYFHYLVPTPMSPSSKSVSTPSEAGSQDSGDLGPLTRTLQWDTDPSVLQLQSDSELGRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGELAVPHNDEWTRFARTLVEIRANRADSEEEGTVELSA

SEQ ID NO: 818357 - protein, 231 aa, Homo sapiens
MSDKSDLKAELERKKQRLAQIREEKKRKEEERKKKEADMQQKKEPVQDDSDLDRKRRETEALLQSIGISPEPPLVPTPMSPSSKSVSTPSEAGSQDSGDLGPLTRTLQWDTDPSVLQLQSDSELGRRLHKLGVSKVTQVDFLPREVVSYSKETQTPLATHQSEEDEEDEEMVESKVGQDSELENQDKKQEVKEAPPREVTEGRKTGRIFTSEEFHTLNGQKRDEEPRGNNA

SEQ ID NO: 818358 - protein, 628 aa, Homo sapiens
MSDKSDLKAELERKKQRLAQIREEKKRKEEERKKKEADMQQKKEPVQDDSDLDRKRRETEALLQSIGISPEPPLVPTPMSPSSKSVSTPSEAGSQDSGDLGPLTRTLQWDTDPSVLQLQSDSELGRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGELAVPHNDEWTRFARTLVEIRANRADSEEEGTVELSA

SEQ ID NO: 818359 - protein, 343 aa, Homo sapiens
MVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGELAVPHNDEWTRFARTLVEIRANRADSEEEGTVELSA

SEQ ID NO: 818360 - protein, 267 aa, Homo sapiens
MHACMHACACMHACMHACACMHACMHACACMHACMHACACMHACMHACACMHACMHACACMHACMHACACMHACMHACACMHACMHACACMHACMHACACMHACMHACACMHACMHACACMHACMHACACMHACMHACACMHACMHACACMHACMHACACMHACMHACACMHACMHACACMHACMHACACMHACMHACACMHACMHACACMHACMHACACMHACMHAMMHACMHACTPGIVLLNPYEARYDWVQMWCSSYYGTGPKT

SEQ ID NO: 818361 - protein, 217 aa, Homo sapiens
YQMETQAEQQELETLPTTKMAQTNPTPGSLGPWKITIYDQENFQGKRMEFTSSCPNVSERSFDNVRSLKVESGAWIGYEHTSFCGQQFILERGEYPRWDAWSGSNAYHIERLMSFRPICSANHKESKMTIFEKENFIGRQWEISDDYPSLQAMGWFNNEVGSMKIQSGAWVCYQYPGYRGYQYILECDHHGGDYKHWREWGSHAQTSQIQSIRRIQQ

SEQ ID NO: 818362 - protein, 922 aa, Homo sapiens
RREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNTTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNRSVSGKRICSYCNNILGKGAAMIIESLGLCYHLHCFKCVACECDLGGSSSGAEVRIRNHQLYCNDCYLRFKSGRPTAM

SEQ ID NO: 818363 - protein, 909 aa, Homo sapiens
RREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNTTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNSVLPVSVTSEALPQELKSGSETTNCTATTAISDSNLDGQPPCDVSLHTKALLQIEEEVVAAHVDL

SEQ ID NO: 818364 - protein, 853 aa, Homo sapiens
RREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNTTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNSWTANRHVM

SEQ ID NO: 818365 - protein, 949 aa, Homo sapiens
RREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKADWGKDQPSLPFIRHKTLNLTSMATKIIGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNTTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNRSVSGKRICSYCNNILGKGAAMIIESLGLCYHLHCFKCVACECDLGGSSSGAEVRIRNHQLYCNDCYLRFKSGRPTAM

SEQ ID NO: 818366 - protein, 565 aa, Homo sapiens
KIGTIQRRLAWPLRKDDSKFVKRSIFEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNTTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNRSVSGKRICSYCNNILGKGAAMIIESLGLCYHLHCFKCVACECDLGGSSSGAEVRIRNHQLYCNDCYLRFKSGRPTAM

SEQ ID NO: 818367 - protein, 498 aa, Homo sapiens
MKTYIVYFSSLPMCCNTGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNTTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNRSVSGKRICSYCNNILGKGAAMIIESLGLCYHLHCFKCVACECDLGGSSSGAEVRIRNHQLYCNDCYLRFKSGRPTAM

SEQ ID NO: 818368 - protein, 922 aa, Homo sapiens; identical to SEQ ID NO: 818362

SEQ ID NO: 818369 - protein, 210 aa, Homo sapiens [sequence omitted]

SEQ ID NO: 818370 - protein, 922 aa, Homo sapiens; identical to SEQ ID NO: 818362

SEQ ID NO: 818371 - protein, 178 aa, Homo sapiens
AIIAQKRDTRNSCKTPQCHSVQPENVPGSASGSEPSAMWQSKNLGQVSDHFSIFAQLSIHSVAVPELSSSQLPSNGSYPEPPALLLPRHIISLVSSNLNFPACEMGPLNLDFPAVLPVSVTSEALPQELKSGSETTNCTATTAISDSNLDGQPPCDVSLHTKALLQIEEEVVAAHVDL

SEQ ID NO: 818372 - protein, 820 aa, Homo sapiens
RREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNTTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAEPWNHGKTFTCTAAYPESKPREVS

SEQ ID NO: 818373 - protein, 631 aa, Homo sapiens
RREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQADHRTGSTRPRI

SEQ ID NO: 818374 - protein, 473 aa, Homo sapiens
RREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKADWGKDQPSLPFIRHKTLNLTSMATKIIGSPETKWIDATSGIYNSEKSSNLSVTTDFSESLQSSNIESKEINGIHDESNAFESKASESISLKNLKRRSQFFEQGKPQS

SEQ ID NO: 818375 - protein, 560 aa, Homo sapiens
RREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKADWGKDQPSLPFIRHKTLNLTSMATKIIGSPETKWIDATSGIYNSEKSSNLSVTTDFSESLQSSNIESKEINGIHDESNAFESKGSSDSVVPDLPVPTISAPSRWVWDQEEERKRQERWQKEQDRLLQEKYSHVSQGRTEGRVATGTQGGERRDSTYFGRGTLSSQPLSRPRGLLRLQATETAMKKITNRKRHTR

SEQ ID NO: 818376 - protein, 302 aa, Homo sapiens
ELFIHKKKRLRTARVSQNPAAVYPAEPPAPGMFRDFGEPGPSSGNGGGYGGPAQPPAAAQAAQQKFHLVPSINTMSGSQELQWMVQPHFLGPSSYPRPLTYPQYSPPQPRPGVIRALGPPPGVRRRPCEQISPEEEERRRVRRERNKLAAAKCRNRRKELTDFLQAETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 818377 - protein, 302 aa, Homo sapiens; identical to SEQ ID NO: 818376

SEQ ID NO: 818378 - protein, 228 aa, Homo sapiens
MSGSQELQWMVQPHFLGPSSYPRPLTYPQYSPPQPRPGVIRALGPPPGVRRRPCEQISPEEEERRRVRRERNKLAAAKCRNRRKELTDFLQAETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 818379 - protein, 266 aa, Homo sapiens
ELFIHKKKRLRTARVSQNPAAVYPAEPPAPGMFRDFGEPGPSSGNGGGYGGPAQPPAAAQAAQQKFHLVPSINTMSGSQELQWMVQPHFLGPSSYPRPLTYPQYSPPQPRPGVIRALGPPPGVRRRPCEQETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 818380 - protein, 308 aa, Homo sapiens
ELFIHKKKRLRTARVSQNPAAVYPAEPPAPGMFRDFGEPGPSSGNGGGYGGPAQPPAAAQAAQQKFHLVPSINTMSGSQELQWMVQPHFLGPSSYPRPLTYPQYSPPQPRPGVIRALGPPPGVRRRPCEQISPEEEERRRVRRERNKLAAAKCRNRRKELTDFLQAETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLNRTAQEAPLASVMS

SEQ ID NO: 818381 - protein, 162 aa, Homo sapiens
MAVLSKEYGFVLLTGAASFIMVAHLAINVSKARKKYKVEYPIMYSTDPENGHIFNCIQRAPPRTRWKVYPPLLIFSSCWEVFTHPRRIASGPWAWPWDCWTSSLCLWLLHGRTPASVVEGALGSNSALLGLGGAQLCALLSSILVGLKVAWAVDPNAAIKEL

SEQ ID NO: 818382 - protein, 189 aa, Homo sapiens
SGSTHAVADSDVLSLSSSCAKDDARRKMAVLSKEYGFVLLTGAASFIMVAHLAINVSKARKKYKVEYPIMYSTDPENGHIFNCIQRAPPRTRWKVYPPLLIFSSCWEVFTHPRRIASGPWAWPWDCWTSSLCLWLLHGRTPASVVEGALGSNSALLGLGGAQLCALLSSILVGLKVAWAVDPNAAIKEL

SEQ ID NO: 818383 - protein, 162 aa, Homo sapiens; identical to SEQ ID NO: 818381

SEQ ID NO: 818384 - protein, 162 aa, Homo sapiens; identical to SEQ ID NO: 818381

SEQ ID NO: 818385 - protein, 162 aa, Homo sapiens; identical to SEQ ID NO: 818381

SEQ ID NO: 818386 - protein, 176 aa, Homo sapiens
MPWRGRRFRLCRRKMAVLSKEYGFVLLTGAASFIMVAHLAINVSKARKKYKVEYPIMYSTDPENGHIFNCIQRAPPRTRWKVYPPLLIFSSCWEVFTHPRRIASGPWAWPWDCWTSSLCLWLLHGRTPASVVEGALGSNSALLGLGGAQLCALLSSILVGLKVAWAVDPNAAIKEL

SEQ ID NO: 818387 - protein, 162 aa, Homo sapiens; identical to SEQ ID NO: 818381

SEQ ID NO: 818388 - protein, 162 aa, Homo sapiens; identical to SEQ ID NO: 818381

SEQ ID NO: 818389 - protein, 162 aa, Homo sapiens; identical to SEQ ID NO: 818381

SEQ ID NO: 818390 - protein, 162 aa, Homo sapiens; identical to SEQ ID NO: 818381

SEQ ID NO: 818391 - protein, 160 aa, Homo sapiens
SDSPLYTIPCIGGAASFIMVAHLAINVSKARKKYKVEYPIMYSTDPENGHIFNCIQRAPPRTRWKVYPPLLIFSSCWEVFTHPRRIASGPWAWPWDCWTSSLCLWLLHGRTPASVVEGALGSNSALLGLGGAQLCALLSSILVGLKVAWAVDPNAAIKEL

SEQ ID NO: 818392 - protein, 162 aa, Homo sapiens; identical to SEQ ID NO: 818381

SEQ ID NO: 818393 - protein, 162 aa, Homo sapiens; identical to SEQ ID NO: 818381

SEQ ID NO: 818394 - protein, 162 aa, Homo sapiens; identical to SEQ ID NO: 818381

SEQ ID NO: 818395 - protein, 146 aa, Homo sapiens
MAVLSKEYGFVLLTGAASFIMVAHLAINVSKARKKYKVEYPIMYSTDPGWKVYPPLLIFSSCWEVFTHPRRIASGPWAWPWDCWTSSLCLWLLHGRTPASVVEGALGSNSALLGLGGAQLCALLSSILVGLKVAWAVDPNAAIKEL

SEQ ID NO: 818396 - protein, 145 aa, Homo sapiens
MAVLSKEYGFVLLTGAASFIMVAHLAINVSKARKKYKVEYPIMYSTDPENGHIFNCIQRAPPRTRWKVYPPLLIFSSCWEVFTHPRNFCSFFFFRTPASVVEGALGSNSALLGLGGAQLCALLSSILVGLKVAWAVDPNAAIKEL

SEQ ID NO: 818397 - protein, 120 aa, Homo sapiens
MAVLSKEYGFVLLTGAASFIMVAHLAINVSKARKKYKVEYPIMYSTDPENGHIFNCIQRAPPRTRWKVYPPLLIFSSCWEVFTHPRTLGTGRLFPRRPCILGEALPFFLVELHPQCSLQN

SEQ ID NO: 818398 - protein, 81 aa, Homo sapiens
SDSPLYTIPCIGGAASFIMVAHLAINVSKARKKYKVEYPIMYSTDPENGHIFNCIQRAPPRTRECRPCRAPKTSAEWVFSV

SEQ ID NO: 818399 - protein, 319 aa, Homo sapiens
RSEPRPGCGNKMAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDPQELVASFSERVRNMSPDEIKIPPEPPGRCSNHLQDKIQKLYERKIKEGMDMNYIIQRKKEFRNPSIYEKLIQFCAIDELGTNYPKDMFDPHGWSEDSYYEALAKAQKIEMDKLEKAKKERTKIEFVTGTKKGTTTNATSTTTTTASTAVADAQKRKSKWDSAIPVTTIAQPTILTTTATLPAVVTVTTSASGSKTTVISAVGTIVKKAKQ

SEQ ID NO: 818400 - protein, 319 aa, Homo sapiens; identical to SEQ ID NO: 818399

SEQ ID NO: 818401 - protein, 319 aa, Homo sapiens; identical to SEQ ID NO: 818399

SEQ ID NO: 818402 - protein, 319 aa, Homo sapiens; identical to SEQ ID NO: 818399

SEQ ID NO: 818403 - protein, 190 aa, Homo sapiens
RSEPRPGCGNKMAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDPQELVASFSERVRNMSPDEIKIPPEPPGRCSNHLQDKIQKLYERKIKEGMDMNYIIQRKKEFRNPRICLIPMAGLRTPTMRH

SEQ ID NO: 818404 - protein, 259 aa, Homo sapiens
RSEPRPGCGNKMAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDPQELVASFSERVRNMSPDEIKIPPEPPGRCSNHLQDKIQKLYERKIKEGMDMNYIIQRKKEFRNPSIYEKLIQFCAIDELGTNYPKDMFDPHGWSEDSYYEALAKAQKIEMDKLEKAKKERTKACCRDVSAAPGDRSCPSPVRAGTASSWV

SEQ ID NO: 818405 - protein, 74 aa, Homo sapiens
GLSLATLRSTFGVWDAQKRKSKWDSAIPVTTIAQPTILTTTATLPAVVTVTTSASGSKTTVISAVGTIVKKAKQ

SEQ ID NO: 818406 - protein, 130 aa, Homo sapiens
RSEPRPGCGNKMAGKKNVLSSLAVYAEDSEPESDGEAGIEAVGSAAEEKGGLVSDAYGEDDFSRLGGDEDGYEEEEDENSRQSEDDDSETEKPEADDPKVFGVGCGGWLDANKVFEHCGSVRMFGQDLSH

SEQ ID NO: 818407 - protein, 113 aa, Homo sapiens
RSEPRPGCGNKMAGKKNVLSSLAVYAEDSEPESDGEAGIEAVGSAAEEKGGLVSDAYGEDDFSRLGGDEDGYEEEEDENSRQSEDDDSETEKPEADDPKVEPAPLVWIPLKTS

SEQ ID NO: 818408 - protein, 319 aa, Homo sapiens; identical to SEQ ID NO: 818399

SEQ ID NO: 818409 - protein, 319 aa, Homo sapiens; identical to SEQ ID NO: 818399

SEQ ID NO: 818410 - protein, 319 aa, Homo sapiens; identical to SEQ ID NO: 818399

SEQ ID NO: 818411 - protein, 197 aa, Homo sapiens
MSPDEIKIPPEPPGRCSNHLQDKIQKLYERKIKEGMDMNYIIQRKKEFRNPSIYEKLIQFCAIDELGTNYPKDMFDPHGWSEDSYYEALAKAQKIEMDKLEKAKKERTKIEFVTGTKKGTTTNATSTTTTTASTAVADAQKRKSKWDSAIPVTTIAQPTILTTTATLPAVVTVTTSASGSKTTVISAVGTIVKKAKQ

SEQ ID NO: 818412 - protein, 197 aa, Homo sapiens; identical to SEQ ID NO: 818411

SEQ ID NO: 818413 - protein, 128 aa, Homo sapiens
MVPTKTIESWGTCELEQLAANEDGRRGHVHLRCQEVKNTALLIGGRPQVVRGQTLSTAPGSRAACPSIWNAKQKLLSGGIWGVGPSPEIYKVAPPTGQWSLGCTVLSSPRVAPQVTAWPSSQWCPQQR

SEQ ID NO: 818414 - protein, 103 aa, Homo sapiens [sequence omitted]

SEQ ID NO: 818415 - protein, 157 aa, Homo sapiens
MGIKHILWVVGAKLVNGTELDQLLVDAERTVPALSRHKSTSLHGTCTIQLLGLHKTFTTFKSSSAALSKLPDGPPTLPRKMDPVNLGAREEHRVKVTAEFCLTDLQSAQLDWAYHTQTHTRAMLFSLYVTSLNIQWRKTRHRSGPKTSHLYAKISFF

SEQ ID NO: 818416 - protein, 189 aa, Homo sapiens
MPHSRSPQTSHGDQTYPGARLSSLVFYPRGGSQVLKNMGARSPHPADPRSSRSTHVPTNQGPGTRPATGISLVDYFRTIGTPTKETGTVLSTIRATMWTFAWLQLKFHGTSKGSWVSPSPSSPVCQTHLWVVGAKLVNGTELDQLLVDAERTVPALQQAQVHVPAWDLNHPAPGADTKPSQLLNPAQLL

SEQ ID NO: 818417 - protein, 302 aa, Homo sapiens
MNSALPIWGRARCLRRTQRGFSLLKELSKQYCIPPGITRSLHMPGTPRPPPHLTCPEPFGQAPPPHTQEEAVPPAQGKDSSGPQALQTRPCNKLLFAPFWPFPICPSQFSGPWLMPHSRSPQTSHGDQTYPGARLSSLVFYPRGGSQVLKNMGARSPHPADPRSSRSTHVPTNQGPGTRPATGISLVDYFRTIGTPTKETGTVLSTIRATMWTFAWLQLNPMEQAKDLGVPITLQPVCQTHLWVVGAKLVNGTELDQLLVDAERTVPALQQAQVHVPAWDLNHPAPGADTKPSQLLNPAQLL

SEQ ID NO: 818418 - protein, 105 aa, Homo sapiens
MKTREAVTKVAPEQLWAEGAYSDPCVLFSGLKAFMGSVFFVLGKMKPALGRHRAGAFSSRLAGCMPCVCPEGSATPELLWTANTRDTGLMGNKDTQEQTMKKSRH

SEQ ID NO: 818419 - protein, 190 aa, Homo sapiens
MNSALPIWGRARCLRRTQRGFSLLKELSKQYCIPPGITRSLHMPGTPRPPPHLTCPEPFGQAPPPHTQEEAVPARTGEGQLRSPGAADTSLQQAWGLEGRGKEREGRFNQGLRMRNPNYPLAPAPTFLAQQPAPPEGHQCPGPTAPLLGVREAVWRPQLLEDGQAEPEVGGAGVLMPGSETGHKGNKAQR

SEQ ID NO: 818420 - protein, 202 aa, Homo sapiens
RSEPRPGCGNKMAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDPQELVASFSERVRNMSPDEIKIPPEPPGRCSNHLQDKIQKLYERKIKEGMDMNYIIQRKKEFRNPSIYEKLIQFCAIDELGTNYPKICLIHMLV

SEQ ID NO: 818421 - protein, 103 aa, Homo sapiens
MVPTKTIESWGTCELEQLAANEDGRRGHVHLRCQEVKNTALLIGGRPQVVRGQTLSTAPGSRAACPSIWNAKQKLLSGGIWGVGPSPEIYKVAPPTGQWSGSR

SEQ ID NO: 818422 - protein, 136 aa, Homo sapiens
RSEPRPGCGNKMAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDPQELVVHKASGSCLASDLNICQGVLAGS

SEQ ID NO: 818423 - protein, 105 aa, Homo sapiens
GRDSWWDDPSWVNGLFAPAPSYACETPQARSFKLNPLNSLSCRKMTIQRLKNLRLMTQRYLVLAVVGGWMQTRCLNTVAQFVCLVKICPTDKLCNCVDIFWDKIS

SEQ ID NO: 818424 - protein, 210 aa, Homo sapiens
SPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 818425 - protein, 210 aa, Homo sapiens; identical to SEQ ID NO: 818424

SEQ ID NO: 818426 - protein, 210 aa, Homo sapiens; identical to SEQ ID NO: 818424

SEQ ID NO: 818427 - protein, 234 aa, Homo sapiens
SPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 818428 - protein, 228 aa, Homo sapiens
SPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 818429 - protein, 210 aa, Homo sapiens; identical to SEQ ID NO: 818424

SEQ ID NO: 818430 - protein, 251 aa, Homo sapiens
SPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 818431 - protein, 166 aa, Homo sapiens
SPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 818432 - protein, 210 aa, Homo sapiens; identical to SEQ ID NO: 818424

SEQ ID NO: 818433 - protein, 193 aa, Homo sapiens
SPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 818434 - protein, 210 aa, Homo sapiens; identical to SEQ ID NO: 818424

SEQ ID NO: 818435 - protein, 210 aa, Homo sapiens; identical to SEQ ID NO: 818424

SEQ ID NO: 818436 - protein, 210 aa, Homo sapiens; identical to SEQ ID NO: 818424

SEQ ID NO: 818437 - protein, 210 aa, Homo sapiens; identical to SEQ ID NO: 818424

SEQ ID NO: 818438 - protein, 210 aa, Homo sapiens; identical to SEQ ID NO: 818424

SEQ ID NO: 818439 - protein, 210 aa, Homo sapiens; identical to SEQ ID NO: 818424

SEQ ID NO: 818440 - protein, 210 aa, Homo sapiens; identical to SEQ ID NO: 818424

SEQ ID NO: 818441 - protein, 296 aa, Homo sapiens
SPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKVSGPDFSTSPSPWPVVLVWGSWLPLLGAPIASLGQGLGLVGDLWWQQQWDGANSRMMALGLVRKHSQEPGTSFGRDNAFWVSRSFLTRTCCFGVSGGTVDTGSLACSRTPTVGRGSGWQRGQLLCVRGNGLFWWLL

SEQ ID NO: 818442 - protein, 156 aa, Homo sapiens
SPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRINLKEAKHIAEEADRKYEEVARKLVTPGG

SEQ ID NO: 818443 - protein, 1173 aa, Homo sapiens
MEELSADEIRRRRLARLAGGQTSQPTTPLTSPQRENPPGPPIAASAPGPSQSLGLNVHNMTPATSPIGASGVAHRSQSSEGVSSLSSSPSNSLETQSQSLSRSQSMDIDGVSCEKSMSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMALGELCETKFGKTHPVCNLVASLRLWLPKSLSPGCGRELQRLSYLGAFFSFSVFAEDDVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAEFLFFIVQYSPQALYEPCTQDIVMFLVVMLCNQNYIRNPYLVAKLVEVMFMTNPAVQPRTQKFFEMIENHPLSTKLLVPSLMKFYTDVEHTGATSEFYDKFTIRYHISTIFKSLWQNIAHHGTFMEEFNSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQRSYSKELFEEVISKMRKAGIKSTIAIEKFKLLAEKVEEIVAKNARAEIDYSDAPDEFRDPLMDTLMTDPVRLPSGTIMDRSIILRHLLNSPTDPFNRQTLTESMLEPVPELKEQIQAWMREKQNSDH

SEQ ID NO: 818444 - protein, 1173 aa, Homo sapiens; identical to SEQ ID NO: 818443

SEQ ID NO: 818445 - protein, 1302 aa, Homo sapiens
MEELSADEIRRRRLARLAGGQTSQPTTPLTSPQRENPPGPPIAASAPGPSQSLGLNVHNMTPATSPIGASGVAHRSQSSEGVSSLSSSPSNSLETQSQSLSRSQSMDIDGVSCEKSMSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLYESSPAPTPSFWSSVPVMGPSLASPSRAASQLAVPSTPLSPHSAASGTAAGSQPSSPRYRPYTVTHPWASSGVSILSSSPSPPALASSPQAVPASSSRQRPSSTGPPLPPASPSATSRRPSSLRISPSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMALGELCETKFGKTHPVCNLVASLRLWLPKSLSPGCGRELQRLSYLGAFFSFSVFAEDDVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAEFLFFIVQYSPQALYEPCTQDIVMFLVVMLCNQNYIRNPYLVAKLVEVMFMTNPAVQPRTQKFFEMIENHPLSTKLLVPSLMKFYTDVEHTGATSEFYDKFTIRYHISTIFKSLWQNIAHHGTFMEEFNSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQRSYSKELFEEVISKMRKAGIKSTIAIEKFKLLAEKVEEIVAKNARAEIDYSDAPDEFRDPLMDTLMTDPVRLPSGTIMDRSIILRHLLNSPTDPFNRQTLTESMLEPVPELKEQIQAWMREKQNSDH

SEQ ID NO: 818446 - protein, 1173 aa, Homo sapiens; identical to SEQ ID NO: 818443

SEQ ID NO: 818447 - protein, 1057 aa, Homo sapiens
MSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMALGELCETKFGKTHPVCNLVASLRLWLPKSLSPGCGRELQRLSYLGAFFSFSVFAEDDVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAEFLFFIVQYSPQALYEPCTQDIVMFLVVMLCNQNYIRNPYLVAKLVEVMFMTNPAVQPRTQKFFEMIENHPLSTKLLVPSLMKFYTDVEHTGATSEFYDKFTIRYHISTIFKSLWQNIAHHGTFMEEFNSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQRSYSKELFEEVISKMRKAGIKSTIAIEKFKLLAEKVEEIVAKNARAEIDYSDAPDEFRDPLMDTLMTDPVRLPSGTIMDRSIILRHLLNSPTDPFNRQTLTESMLEPVPELKEQIQAWMREKQNSDH

SEQ ID NO: 818448 - protein, 296 aa, Homo sapiens
MYDHVQYNCLSSSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQRSYSKELFEEVISKMRKAGIKSTIAIEKFKLLAEKVEEIVAKNARAEIDYSDAPDEFRDPLMDTLMTDPVRLPSGTIMDRSIILRHLLNSPTDPFNRQTLTESMLEPVPELKEQIQAWMREKQNSDH

SEQ ID NO: 818449 - protein, 642 aa, Homo sapiens
MAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAEFLFFIVQYSPQALYEPCTQDIVMFLVVMLCNQNYIRNPYLVAKLVEVMFMTNPAVQPRTQKFFEMIENHPLSTKLLVPSLMKFYTDVEHTGATSEFYDKFTIRYHISTIFKSLWQNIAHHGTFMEEFNSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQRSYSKELFEEVISKMRKAGIKSTIAIEKFKLLAEKVEEIVAKNARAEIDYSDAPDEFRDPLMDTLMTDPVRLPSGTIMDRSIILRHLLNSPTDPFNRQTLTESMLEPVPELKEQIQAWMREKQNSDH

SEQ ID NO: 818450 - protein, 1173 aa, Homo sapiens; identical to SEQ ID NO: 818443

SEQ ID NO: 818451 - protein, 183 aa, Homo sapiens
MLNFNLQQLCGPKCRDLKVENPEKYGFEPKKLLDQLTDIYLQLDCARFAKAIADDQRSYSKELFEEVISKMRKAGIKSTIAIEKFKLLAEKVEEIVAKNARAEIDYSDAPDEFRDPLMDTLMTDPVRLPSGTIMDRSIILRHLLNSPTDPFNRQTLTESMLEPVPELKEQIQAWMREKQNSDH

SEQ ID NO: 818452 - protein, 1217 aa, Homo sapiens
MEELSADEIRRRRLARLAGGQTSQPTTPLTSPQRENPPGPPIAASAPGPSQSLGLNVHNMTPATSPIGASGVAHRSQSSEGVSSLSSSPSNSLETQSQSLSRSQSMDIDGVSCEKSMSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMALGELCETKFGKTHPVCNLVASLRLWLPKSLSPGCGRELQRLSYLGAFFSFSVFAEDDVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAEFLFFIVQYSPQALYEPCTQDIVMFLVVMLCNQNYIRNPYLVAKLVEVMFMTNPAVQPRTQKFFEMIENHPLSTKLLVPSLMKFYTDVEHTGATSEFYDKFTIRYHISTIFKSLWQNIAHHGTFMEEFNSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQNTHHCVTTADRIQYSPTLYSFVAYGAIGYTIEPRRGVGHAIQVCRSYSKELFEEVISKMRKAGIKSTIAIEKFKLLAEKVEEIVAKNARAEIDYSDAPDEFRDPLMDTLMTDPVRLPSGTIMDRSIILRHLLNSPTDPFNRQTLTESMLEPVPELKEQIQAWMREKQNSDH

SEQ ID NO: 818453 - protein, 1164 aa, Homo sapiens
MEELSADEIRRRRLARLAGGQTSQPTTPLTSPQRENPPGPPIAASAPGPSQSLGLNVHNMTPATSPIGASGVAHRSQSSEGVSSLSSSPSNSLETQSQSLSRSQSMDIDGVSCEKSMSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMALGELCETKFGKTHPVCNLVASLRLWLPKSLSPGCGRELQRLSYLGAFFSFSVFAEDDVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAEFLFFIVQYSPQALYEPCTQDIVMFLVVMLCNQNYIRNPYLVAKLVEVMFMTNPAVQPRTQKFFEMIENHPLSTKLLVPSLMKFYTDVEHTGATSEFYDKFTIRYHISTIFKSLWQNIAHHGTFMEEFNSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQRSYSKELFEEVISKMRKAGIKSTIAIEKFKLLAEKVEEIVAKNARAEIDYSDAPDEFRGVDERETEQRSLNRSAAHPLLDTAKANEASRSSGRSEAAVHVLEAKCGKPTPGPPRASKR

SEQ ID NO: 818454 - protein, 113 aa, Homo sapiens [sequence omitted]

SEQ ID NO: 818455 - protein, 119 aa, Homo sapiens
DLKPDNNPEDSKGRAAFASGDSHFQRIPRSPKTKNSSLPSSPRSLWGLLLDPLMDTLMTDPVRLPSGTIMDRSIILRHLLNSPTDPFNRQTLTESMLEPVPELKEQIQAWMREKQNSDH

SEQ ID NO: 818456 - protein, 1197 aa, Homo sapiens
MEELSADEIRRRRLARLAGGQTSQPTTPLTSPQRENPPGPPIAASAPGPSQSLGLNVHNMTPATSPIGASGVAHRSQSSEGVSSLSSSPSNSLETQSQSLSRSQSMDIDGVSCEKSMSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMALGELCETKFGKTHPVCNLVASLRLWLPKSLSPGCGRELQRLSYLGAFFSFSVFAEDDVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAEFLFFIVQYSPQALYEPCTQDIVMFLVVMLCNQNYIRNPYLVAKLVEVMFMTNPAVQPRTQKFFEMIENHPLSTKLLVPSLMKFYTDVEHTGATSEFYDKFTIRYHISTIFKSLWQNIAHHGTFMEEFNSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQRSYSKELFEEVISKMRKAGIKSTIAIEKFKLLAEKVEEIVAKNARAEIDYSDAPDEFRDPLMDTLMTDPVRLPSGTIMDRSIILRHLLNSPTDPFNRQTLTESMLEPVPELKEQIQAWMREKPGPGDTLAARRSIAQRSFSQNTALPGSHS

SEQ ID NO: 818457 - protein, 1069 aa, Homo sapiens
MEELSADEIRRRRLARLAGGQTSQPTTPLTSPQRENPPGPPIAASAPGPSQSLGLNVHNMTPATSPIGASGVAHRSQSSEGVSSLSSSPSNSLETQSQSLSRSQSMDIDGVSCEKSMSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMALGELCETKFGKTHPVCNLVASLRLWLPKSLSPGCGRELQRLSYLGAFFSFSVFAEDDVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELYGDQPPFSEPKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAEFLFFIVQYSPQALYEPCTQDIVMFLVVMLCNQNYIRNPYLVAKLVEVMFMTNPAVQPRTQKFFEMIENHPLSTKLLVPSLMKFYTDVEHTGATSEFYDKFTIRYHISTIFKSLWQNIAHHGTFMEEFNSGKQFVRYINMLINDTTFLLDESLESLKRIHEVQEEMKNKEQWDQLPRDQQQARQSQLAQDERVSRSYLALATETVDMFHILTKQVQKPFLRPELGPRLAAMLNFNLQQLCGPKCRDLKVENPEKYGFEPKKLLDQLTDIYLQLDCARFAKAIADDQNTHHCVTTADRIQYSPTLYSFVA

SEQ ID NO: 818458 - protein, 637 aa, Homo sapiens
MEELSADEIRRRRLARLAGGQTSQPTTPLTSPQRENPPGPPIAASAPGPSQSLGLNVHNMTPATSPIGASGVAHRSQSSEGVSSLSSSPSNSLETQSQSLSRSQSMDIDGVSCEKSMSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMALGELCETKFGKTHPVCNLVASLRLWLPKSLSPGCGRELQRLSYLGAFFSFSVFAEDDVKVVEKYFSGPAITLENTRVVSQSLQHYLELGRQELFKILHSILLNGETREAALSYMAAVVNANMKKAQMQTDDRLVSTDGFMLNFLWVLQQLSTKIKLETVDPTYIFHPRCRITLPNDETRVNATMEDVNDWLTELCEYCVRDSVIKTLPSCLCASSSSSA

SEQ ID NO: 818459 - protein, 477 aa, Homo sapiens
MEELSADEIRRRRLARLAGGQTSQPTTPLTSPQRENPPGPPIAASAPGPSQSLGLNVHNMTPATSPIGASGVAHRSQSSEGVSSLSSSPSNSLETQSQSLSRSQSMDIDGVSCEKSMSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLGASGGASNWDSYSDHFTIETCKETDMLNYLIECFDRVGIEEKKAPKMCSQPAVSQLLSNIRSQCISHTALVLQGSLTQPRSLQQPSFLVPYMLCRNLPYGFIQELVRTTHQDEEVFKQIFIPILQGLALAAKECSLDSDYFKYPLMVKLCSFSLTHSIDVFLSDYFDIYFSFRSMRSTLFSNLKHEITVLAMQSVWCAVRCISEDS

SEQ ID NO: 818460 - protein, 443 aa, Homo sapiens
MEELSADEIRRRRLARLAGGQTSQPTTPLTSPQRENPPGPPIAASAPGPSQSLGLNVHNMTPATSPIGASGVAHRSQSSEGVSSLSSSPSNSLETQSQSLSRSQSMDIDGVSCEKSMSQVDVDSGIENMEVDENDRREKRSLSDKEPSSGPEVSEEQALQLVCKIFRVSWKDRDRDVIFLSSLSAQFKQNPKEVFSDFKDLIGQILMEVLMMSTQTRDENPFASLTATSQPIAAAARSPDRNLLLNTGSNPGTSPMFCSVASFGASSLSSLYESSPAPTPSFWSSVPVMGPSLASPSRAASQLAVPSTPLSPHSAASGTAAGSQPSSPRYRPYTVTHPWASSGVSILSSSPSPPALASSPQAVPASSSRQRPSSTGPPLPPASPSATSRRPSSLRISPRYLSHRRVACVFAVQGKEINTVWKKCCVTLTLLNCCFGLLTCVAN

SEQ ID NO: 818461 - protein, 86 aa, Homo sapiens
MTDPVRLPSGTIMDRSIILRHLLNSPTDPFNRQTLTESMLEPGQRRVQFEVQRWRQYQEIKPKSHIGDEAEGKFIKCRNYLLYDTL

SEQ ID NO: 818462 - protein, 79 aa, Homo sapiens
VARSLRIKEEESTLFTDGPSLLTLIFNSMELYCLFLVVLTSTFPFQMCSQPAVSQLLSNIRSQCISHTALVLQGSLTQP

SEQ ID NO: 818463 - protein, 469 aa, Homo sapiens
MAQGNNYGQTSNGVADESPNMLVYRKMEDVIARMQDEKNGIPIRTVKSFLSKIPSVFSGSDIVQWLIKNLTIEDPVEALHLGTLMAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKGKSLTSKRLTSLAQSY

SEQ ID NO: 818464 - protein, 495 aa, Homo sapiens
MAQGNNYGQTSNGVADESPNMLVYRKMEDVIARMQDEKNGIPIRTVKSFLSKIPSVFSGSDIVQWLIKNLTIEDPVEALHLGTLMAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKSGNSMDRRTSFEKFAQNVGRNIPIFPCHKNCTPTLRASTNLL

SEQ ID NO: 818465 - protein, 463 aa, Homo sapiens
MLDGRARWLTPVISALWEAEMEDVIARMQDEKNGIPIRTVKSFLSKIPSVFSGSDIVQWLIKNLTIEDPVEALHLGTLMAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKGKSLTSKRLTSLAQSY

SEQ ID NO: 818466 - protein, 631 aa, Homo sapiens
SQPSRRGGERQGLVARARLSLRPSIPELSERTSRPCRASPASLPSQHTSSPAQARVRNLAQSTFPLAAQETPGRAPAHAPLSSFVPGVGGRSPASVGISAPGGGPSGAAAKMPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQNMKGSRSSADSSRKH

SEQ ID NO: 818467 - protein, 625 aa, Homo sapiens
SQPSRRGGERQGLVARARLSLRPSIPELSERTSRPCRASPASLPSQHTSSPAQARVRNLAQSTFPLAAQETPGRAPAHAPLSSFVPGVGGRSPASVGISAPGGGPSGAAAKMPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQPLLGQACLT

SEQ ID NO: 818468 - protein, 146 aa, Homo sapiens [sequence omitted]

SEQ ID NO: 818469 - protein, 631 aa, Homo sapiens; identical to SEQ ID NO: 818466

SEQ ID NO: 818470 - protein, 631 aa, Homo sapiens; identical to SEQ ID NO: 818466

SEQ ID NO: 818471 - protein, 634 aa, Homo sapiens
SQPSRRGGERQGLVARARLSLRPSIPELSERTSRPCRASPASLPSQHTSSPAQARVRNLAQSTFPLAAQETPGRAPAHAPLSSFVPGVGGRSPASVGISAPGGGPSGAAAKMPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQPLLGQACLNWKGVMRNAA

SEQ ID NO: 818472 - protein, 637 aa, Homo sapiens
SQPSRRGGERQGLVARARLSLRPSIPELSERTSRPCRASPASLPSQHTSSPAQARVRNLAQSTFPLAAQETPGRAPAHAPLSSFVPGVGGRSPASVGISAPGGGPSGAAAKMPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQPLLGQACLRTVCHIFSKFSPY

SEQ ID NO: 818473 - protein, 670 aa, Homo sapiens
SQPSRRGGERQGLVARARLSLRPSIPELSERTSRPCRASPASLPSQHTSSPAQARVRNLAQSTFPLAAQETPGRAPAHAPLSSFVPGVGGRSPASVGISAPGGGPSGAAAKMPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEGLSLFPRLECGGAVTAHCSLNLLGSSDPPASASRELRLQDAKKGPNPLMRRNSVTPLASPEPTKKPRINSFEEHVASTSAALPSCLPPEVPTQLPGQNMKGSRSSADSSRKH

SEQ ID NO: 818474 - protein, 573 aa, Homo sapiens
SQPSRRGGERQGLVARARLSLRPSIPELSERTSRPCRASPASLPSQHTSSPAQARVRNLAQSTFPLAAQETPGRAPAHAPLSSFVPGVGGRSPASVGISAPGGGPSGAAAKMPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSENMKGSRSSADSSRKH

SEQ ID NO: 818475 - protein, 538 aa, Homo sapiens
SQPSRRGGERQGLVARARLSLRPSIPELSERTSRPCRASPASLPSQHTSSPAQARVRNLAQSTFPLAAQETPGRAPAHAPLSSFVPGVGGRSPASVGISAPGGGPSGAAAKMPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDASYQDLVQRLEPVIMELERQENVLVICHQAVLRCLLAYFLDKSAEEMPYLKCPLHTVLKLTPVAYGCRVESIYLNVESVCTHRERSENMKGSRSSADSSRKH

SEQ ID NO: 818476 - protein, 528 aa, Homo sapiens
APRVAGLPLGRRPVWVSRAGPAGSAPGAMPFRKACGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQNMKGSRSSADSSRKH

SEQ ID NO: 818477 - protein, 631 aa, Homo sapiens; identical to SEQ ID NO: 818466

SEQ ID NO: 818478 - protein, 631 aa, Homo sapiens; identical to SEQ ID NO: 818466

SEQ ID NO: 818479 - protein, 631 aa, Homo sapiens; identical to SEQ ID NO: 818466

SEQ ID NO: 818480 - protein, 530 aa, Homo sapiens
SQPSRRGGERQGLVARARLSLRPSIPELSERTSRPCRASPASLPSQHTSSPAQARVRNLAQSTFPLAAQETPGRAPAHAPLSSFVPGVGGRSPASVGISAPGGGPSGAAAKMPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGEVSAGWGGLTVPSTHDHCCAGLGHPSREFTSVWVLGAPTPSTSELSPPKLNLLTAWGEV

SEQ ID NO: 818481 - protein, 69 aa, Homo sapiens
LVQRLEPVIMELERQENVLVICHQAVLRCLLAYFLDKSAGTSGRSWPRDGGRRGLALGGGSAADLPWPA

SEQ ID NO: 818482 - protein, 607 aa, Homo sapiens
MWMTPKRSKMEVDEALVFRPEWTQRYLVVEPPEGDGALCLVCRRLIVATRERDVRRHYEAEHEYYERYVADGERAALVERLRQGDLPVASFTPEERAARAGLGLCRLLALKGRGWGEGDFVYQCMEVLLREVLPEHVSVLQGVDLSPDITRQRILSIDRNLRNQLFNRARDFKAYSLALDDQAFVAYENYLLVFIRGVGPELEVQEDLLTIINLTHHFSVGALMSAILESLQTAGLSLQRMVGLTTTHTLRMIGENSGLVSYMREKAVSPNCWNVIHYSGFLHLELLSSYDVDVNQIINTISEWIVLIKTRGVRRPEFQTLLTESESEHGERVNGRCLNNWLRRGKTLKLIFSLRKEMEAFLVSVGATTVHFSDKQWLCDFGFLVDIMEHLRELSEELRVSKVFAAAAFDHICTFEVKLNLFQRHIEEKNLTDFPALREVVDELKQQNKEDEKIFDPDRYQMVICRLQKEFERHFKDLRFIKKDLELFSNPFNFKPEYAPISVRVELTKLQANTNLWNEYRIKDLGQFYAGLSAESYPIIKGVACKVASLFDSNQICEKAFSYLTRNQHTLSQPLTDEHLQALFRVATTEMEPGWDDLVRERNESNP

SEQ ID NO: 818483 - protein, 607 aa, Homo sapiens; identical to SEQ ID NO: 818482

SEQ ID NO: 818484 - protein, 607 aa, Homo sapiens; identical to SEQ ID NO: 818482

SEQ ID NO: 818485 - protein, 607 aa, Homo sapiens; identical to SEQ ID NO: 818482

SEQ ID NO: 818486 - protein, 126 aa, Homo sapiens
TGAATARRESLPQANNPEQLCKQRCINEASWTMKRVLSCVPEPTVVMAARALCMLGLVLALLSSSSAEEYVGLSANQCAVPAKDRVDCGYPHVTPKECNNRGCCFDSRIPGVPWCFKPLQEAECTF

SEQ ID NO: 818487 - protein, 117 aa, Homo sapiens
MGPLFVKTSGSRYELSAEALAGSKGTERLRSTWACLQTSVPCQPRTGWTAATPMSPPRSATTGAAALTPGSLECLGVSSPCRKQNAPSEAPPAAPGRGMRGSEHPCPAVIAARHNVL

SEQ ID NO: 818488 - protein, 73 aa, Homo sapiens
EKLRRTVPGSNHSRARAANQCAVPAKDRVDCGYPHVTPKECNNRGCCFDSRIPGVPWCFKPLQEAGKAPVASW

SEQ ID NO: 818489 - protein, 126 aa, Homo sapiens; identical to SEQ ID NO: 818486

SEQ ID NO: 818490 - protein, 130 aa, Homo sapiens
MGPLFVKTSGSRYELSAEALAGSKGTERLRSTWACLQTSVPCQPRTGWTAATPMSPPRSATTGAAALTPGSLECLGVSSPCRKQNAPSEAPPAAPGRGMRGSEHPCPAVIAARHCSSQLFCPFAPGKRFC

SEQ ID NO: 818491 - protein, 120 aa, Homo sapiens
TGAATARRESLPQANNPEQLCKQRCINEASWTMKRVLSCVPEPTVVMAARALCMLGLVLALLSSSSAEEYVGLSQQGLWQLTGLCLGQLCKPVCRASQGQGGLRLPPCHPQGVQQPGLLL

SEQ ID NO: 818492 - protein, 525 aa, Homo sapiens
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRGGEGTGYFVDFSVRNCSRHHFPRHPNVFGFCRANLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRHSHNNNSSDLHPHKHHSHEQHPHGHHPHAHHPHEHDTHRQHPHGHHPHGHHPHGHHPHGHHPHGHHPHCHDFQDYGPCDPPPHNQGHCCHGHGPPPGHLRRRGPGKGPCPFHCRQIGSVYRLPPLRKGEVLPLPEANFPSFPLPHHKHPLKPDIQPFPQSVSESCPGKFKSGFPQVSMFFTHTFPK

SEQ ID NO: 818493 - protein, 233 aa, Homo sapiens
IRAAGIGTRALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYSSFRVDRIERVARVRGGEGTGYFVDFSVRNCSRHHFPRHPNVFDSETDCLCEKLDLEADYLHNCELDLRHGH

SEQ ID NO: 818494 - protein, 245 aa, Homo sapiens
IRAAGIGTRALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVREGGTVLVTLWRTAQHSQHPMSLILRQIVYVRSWTGKPATCITVSLTSDMDI

SEQ ID NO: 818495 - protein, 514 aa, Homo sapiens
IRAAGIGTRALIAALLLITLQYSCAVSPTDCSAVEPEAEKALDLINKRRRDGYLFQLLRIADAHLDRVVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRGGEGTGYFVDFSVRNCSRHHFPRHPNVFGFCRANLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRHSHNNNSSDLHPHKHHSHEQHPHGHHPHAHHPHEHDTHRQHPHGHHPHGHHPHGHHPHGHHPHGHHPHCHDFQDYGPCDPPPHNQGHCCHGHGPPPGHLRRRGPGKGPCPFHCRQIGSVYRLPPLRKGEVLPLPEANFPSFPLPHHKHPLKPDIQPFPQSVSESCPGKFKSGFPQVSMFFTHTFPK

SEQ ID NO: 818496 - protein, 525 aa, Homo sapiens; identical to SEQ ID NO: 818492

SEQ ID NO: 818497 - protein, 525 aa, Homo sapiens; identical to SEQ ID NO: 818492

SEQ ID NO: 818498 - protein, 454 aa, Homo sapiens
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRGGEGTGYFVDFSVRNCSRHHFPRHPNVFGFCRANLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRHSHNNNSSDLHPHKHHSHEQHPHGHHPHAHHPHEHDTHRQHPHGHHPHGHHPHGHHPHGHHPHGHHPHCHDFQDYGPCDPPPHNQGHCCHGHGPPPGHLRRPIFPASHCRTTNIL

SEQ ID NO: 818499 - protein, 466 aa, Homo sapiens
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRGGEGTGYFVDFSVRNCSRHHFPRHPNVFGFCRANLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRHSHNNNSSDLHPHKHHSHEQHPHGPPPGHLRRRGPGKGPRPFHCRQIGSVYRHPHGHHPHGHHPHGHHPHGHHPHGHHPHCHDFQDYGPCDPPPHNQGHCCHGHGPPPGHLRRPIFPASHCRTTNIL

SEQ ID NO: 818500 - protein, 509 aa, Homo sapiens
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRGGEGTGYFVDFSVRNCSRHHFPRHPNVFGFCRANLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRHSHNNNSSDLHPHKHHSHEQHPHGHHPHAHHPHEHDTHRQHPHGHHPHGHHPHGHHPHGHHPHGHHPHCHDFQDYGPCDPPPHNQGHCCHGHGPPPGHLRRRGPGKGPCPFHCRQIGSVYRLPPLRKGEVLPLPEANFPSFPLPHHKHPLKPDIQPFPQVSMFFTHTFPK

SEQ ID NO: 818501 - protein, 224 aa, Homo sapiens
IRAAGIGTRALIAALLLITLQYSCAVSPTDCSAVEPEAEKALDLINKRRRDGYLFQLLRIADAHLDRVVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRDGKDLTRDSLAELSDTFPAPNALDLRADCLYDGHHVDRSLDIWCMTHS

SEQ ID NO: 818502 - protein, 231 aa, Homo sapiens
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRDGKDLTRDSLAELSDTFPAPNALDLRADCLYDGHHVTAHWTSGA

SEQ ID NO: 818503 - protein, 191 aa, Homo sapiens
MNAHMRIIEWWRPVMFALVMLTLEDKDMKGFSWAIVPALTSLGYLIILVVSIFPFWVRLTNEESHEVFFSGLFENCFNAKCWKPRPLSRACAFLALVLHALEIKALRMKLGPLQFSVLWPYYVLGFGIFLFIVAGTICLIQEMVCPCWHLLSTSQSMEEDHGSLYLDNLESLGGEPSSVQKETQVTAETVI

SEQ ID NO: 818504 - protein, 181 aa, Homo sapiens
MEEIPAQEAAGSPRVQFQSLETQSECLSPEPQFVQDTDMEQGLTGAPPVPQVPALPREGSPGDQAAALLTARYQEFVTFEDVAVHLTREEWGYLDPVQRDLYREVMLENYGNVVSLGILLRLPTTRIHSVNSCPALSHTQASAFSGETLAVLTAGISKRWPKYRLPIDIARPCSETPFPRL

SEQ ID NO: 818505 - protein, 512 aa, Homo sapiens
MIFILWPWCYSVLIPQSSQDVLFQEFVTFEDVAVHLTREEWGYLDPVQRDLYREVMLENYGNVVSLDGETREENKLLIPKQKISEEVHSYKVRVGRLKHDITQVPETREVYKSEDRLERLQEILRKFLYLEREFRQITISKETFTSEKNNECHEPEKSFSLDSTIDADQRVLRIQNTDDNDKYDMSFNQNSASGKHEHLNLTEDFQSSECKESLMDLSHLNKWESIPNTEKSYKCDVCGKIFHQSSALTRHQRIHTREKPYKCKECEKSFSQSSSLSRHKRIHTREKPYKCEASDKSCEASDKSCSPSSGIIQHKKIHTRAKSYKCSSCERVFSRSVHLTQHQKIHKEMPCKCTVCGSDFCHTSYLLEHQRVHHEEKAYEYDEYGLAYIKQQGIHFREKPYTCSECGKDFRLNSHLIQHQRIHTGEKAHECNECGKAFSQTSCLIQHHKMHRKEKSYECNEYEGSFSHSSDLILQQEVLTRQKAFDCDVWEKNSSQRAHLVQHQSIHTKENS

SEQ ID NO: 818506 - protein, 526 aa, Homo sapiens
MEEIPAQEAAGSPRVQFQSLETQSECLSPEPQFVQDTDMEQGLTGGFPISKPDGISQLEQDLQVFDLETKTREVLRDDCSDGETREENKLLIPKQKISEEVHSYKVRVGRLKHDITQVPETREVYKSEDRLERLQEILRKFLYLEREFRQITISKETFTSEKNNECHEPEKSFSLDSTIDADQRVLRIQNTDDNDKYDMSFNQNSASGKHEHLNLTEDFQSSECKESLMDLSHLNKWESIPNTEKSYKCDVCGKIFHQSSALTRHQRIHTREKPYKCKECEKSFSQSSSLSRHKRIHTREKPYKCEASDKSCEASDKSCSPSSGIIQHKKIHTRAKSYKCSSCERVFSRSVHLTQHQKIHKEMPCKCTVCGSDFCHTSYLLEHQRVHHEEKAYEYDEYGLAYIKQQGIHFREKPYTCSECGKDFRLNSHLIQHQRIHTGEKAHECNECGKAFSQTSCLIQHHKMHRKEKSYECNEYEGSFSHSSDLILQQEVLTRQKAFDCDVWEKNSSQRAHLVQHQSIHTKENS

SEQ ID NO: 818507 - protein, 491 aa, Homo sapiens
MEEIPAQEAAGSPRVQFQSLETQSECLSPEPQFVQDTDMEQGLTGDGETREENKLLIPKQKISEEVHSYKVRVGRLKHDITQVPETREVYKSEDRLERLQEILRKFLYLEREFRQITISKETFTSEKNNECHEPEKSFSLDSTIDADQRVLRIQNTDDNDKYDMSFNQNSASGKHEHLNLTEDFQSSECKESLMDLSHLNKWESIPNTEKSYKCDVCGKIFHQSSALTRHQRIHTREKPYKCKECEKSFSQSSSLSRHKRIHTREKPYKCEASDKSCEASDKSCSPSSGIIQHKKIHTRAKSYKCSSCERVFSRSVHLTQHQKIHKEMPCKCTVCGSDFCHTSYLLEHQRVHHEEKAYEYDEYGLAYIKQQGIHFREKPYTCSECGKDFRLNSHLIQHQRIHTGEKAHECNECGKAFSQTSCLIQHHKMHRKEKSYECNEYEGSFSHSSDLILQQEVLTRQKAFDCDVWEKNSSQRAHLVQHQSIHTKENS

SEQ ID NO: 818508 - protein, 562 aa, Homo sapiens
MEEIPAQEAAGSPRVQFQSLETQSECLSPEPQFVQDTDMEQGLTGAPPVPQVPALPREGSPGDQAAALLTARYQEFVTFEDVAVHLTREEWGYLDPVQRDLYREVMLENYGNVVSLDGETREENKLLIPKQKISEEVHSYKVRVGRLKHDITQVPETREVYKSEDRLERLQEILRKFLYLEREFRQITISKETFTSEKNNECHEPEKSFSLDSTIDADQRVLRIQNTDDNDKYDMSFNQNSASGKHEHLNLTEDFQSSECKESLMDLSHLNKWESIPNTEKSYKCDVCGKIFHQSSALTRHQRIHTREKPYKCKECEKSFSQSSSLSRHKRIHTREKPYKCEASDKSCEASDKSCSPSSGIIQHKKIHTRAKSYKCSSCERVFSRSVHLTQHQKIHKEMPCKCTVCGSDFCHTSYLLEHQRVHHEEKAYEYDEYGLAYIKQQGIHFREKPYTCSECGKDFRLNSHLIQHQRIHTGEKAHECNECGKAFSQTSCLIQHHKMHRKEKSYECNEYEGSFSHSSDLILQQEVLTRQKAFDCDVWEKNSSQRAHLVQHQSIHTKENS

SEQ ID NO: 818509 - protein, 512 aa, Homo sapiens; identical to SEQ ID NO: 818505

SEQ ID NO: 818510 - protein, 512 aa, Homo sapiens; identical to SEQ ID NO: 818505

SEQ ID NO: 818511 - protein, 526 aa, Homo sapiens; identical to SEQ ID NO: 818506

SEQ ID NO: 818512 - protein, 327 aa, Homo sapiens
ARYEAGWRGKHEHLNLTEDFQSSECKESLMDLSHLNKWESIPNTEKSYKCDVCGKIFHQSSALTRHQRIHTREKPYKCKECEKSFSQSSSLSRHKRIHTREKPYKCEASDKSCEASDKSCSPSSGIIQHKKIHTRAKSYKCSSCERVFSRSVHLTQHQKIHKEMPCKCTVCGSDFCHTSYLLEHQRVHHEEKAYEYDEYGLAYIKQQGIHFREKPYTCSECGKDFRLNSHLIQHQRIHTGEKAHECNECGKAFSQTSCLIQHHKMHRKEKSYECNEYEGSFSHSSDLILQQEVLTRQKAFDCDVWEKNSSQRAHLVQHQSIHTKENS

SEQ ID NO: 818513 - protein, 512 aa, Homo sapiens; identical to SEQ ID NO: 818505

SEQ ID NO: 818514 - protein, 512 aa, Homo sapiens; identical to SEQ ID NO: 818505

SEQ ID NO: 818515 - protein, 512 aa, Homo sapiens; identical to SEQ ID NO: 818505

SEQ ID NO: 818516 - protein, 512 aa, Homo sapiens; identical to SEQ ID NO: 818505

SEQ ID NO: 818517 - protein, 181 aa, Homo sapiens; identical to SEQ ID NO: 818504

SEQ ID NO: 818518 - protein, 110 aa, Homo sapiens
MEEIPAQEAAGSPRVQFQSLETQSECLSPEPQFVQDTDMEQGLTGGILLRLPTTRIHSVNSCPALSHTQASAFSGETLAVLTAGISKRWPKYRLPIDIARPCSETPFPRL

SEQ ID NO: 818519 - protein, 105 aa, Homo sapiens [sequence omitted]

SEQ ID NO: 818520 - protein, 123 aa, Homo sapiens
MEEIPAQEAAGSPRVQFQSLETQSECLSPEPQFVQDTDMEQGLTGAPPVPQVPALPREGSPGDQAAALLTARYQEFVTFEDVAVHLTREEWGYLDPVQRDLYREVMLENYGNVVSLGTVGSWD

SEQ ID NO: 818521 - protein, 110 aa, Homo sapiens; identical to SEQ ID NO: 818518

SEQ ID NO: 818522 - protein, 97 aa, Homo sapiens
QRNKQETKEKGGRLPTGTVFSVFSIPGSLIFVGILLRLPTTRIHSVNSCPALSHTQASAFSGETLAVLTAGISKRWPKYRLPIDIARPCSETPFPRL

SEQ ID NO: 818523 - protein, 120 aa, Homo sapiens
FFFFPLALSMLVASRALLCLPDYAQDSRSSYLWGGRLPTGTVFSVFSIPGSLIFVGILLRLPTTRIHSVNSCPALSHTQASAFSGETLAVLTAGISKRWPKYRLPIDIARPCSETPFPRL

SEQ ID NO: 818524 - protein, 248 aa, Homo sapiens
MEGSGTGKRRGKAAKTSLRIMDARAQLLLRVPHPGAVTHIRGPHSHPGPSSGALTHIRDPHAWAEEGGPSFGTLHSVAGSATEKRRPRGCLQRPGRGCGGPERECVGDRTAARPAPPLGEYPEAVLGSQRGGSLFCLHGSRRRRRPAAADGSSLPRECAEARVRGGDLYREVMLENYGNVVSLGILLRLPTTRIHSVNSCPALSHTQASAFSGETLAVLTAGISKRWPKYRLPIDIARPCSETPFPRL

SEQ ID NO: 818525 - protein, 512 aa, Homo sapiens; identical to SEQ ID NO: 818505

SEQ ID NO: 818526 - protein, 181 aa, Homo sapiens; identical to SEQ ID NO: 818504

SEQ ID NO: 818527 - protein, 236 aa, Homo sapiens
MKLRQDQPALTHHGVMLTLEDKDMKGFSWAIVPALTSLGYLIILVVSIFPFWVRLTNEESHEVFFSGLFENCFNAKCWKPRPLSIYIILGRVFLLSAVFLAFVTTFIMMPFASEFFPRTWKQNFVLACISFFTGACAFLALVLHALEIKALRMKLGPLQFSVLWPYYVLGFGIFLFIVAGTICLIQEMVCPCWHLLSTSQSMEEDHGSLYLDNLESLGGEPSSVQKETQVTAETVI

SEQ ID NO: 818528 - protein, 236 aa, Homo sapiens; identical to SEQ ID NO: 818527

SEQ ID NO: 818529 - protein, 221 aa, Homo sapiens
MLTLEDKDMKGFSWAIVPALTSLGYLIILVVSIFPFWVRLTNEESHEVFFSGLFENCFNAKCWKPRPLSIYIILGRVFLLSAVFLAFVTTFIMMPFASEFFPRTWKQNFVLACISFFTGACAFLALVLHALEIKALRMKLGPLQFSVLWPYYVLGFGIFLFIVAGTICLIQEMVCPCWHLLSTSQSMEEDHGSLYLDNLESLGGEPSSVQKETQVTAETVI

SEQ ID NO: 818530 - protein, 282 aa, Homo sapiens
QERGGAWSGGRGSHRDPPGGQPSSGTRNRLRRCQFQEPLSSCLFSSLNPHHWPTLGVGRPVMLTLEDKDMKGFSWAIVPALTSLGYLIILVVSIFPFWVRLTNEESHEVFFSGLFENCFNAKCWKPRPLSIYIILGRVFLLSAVFLAFVTTFIMMPFASEFFPRTWKQNFVLACISFFTGACAFLALVLHALEIKALRMKLGPLQFSVLWPYYVLGFGIFLFIVAGTICLIQEMVCPCWHLLSTSQSMEEDHGSLYLDNLESLGGEPSSVQKETQVTAETVI

SEQ ID NO: 818531 - protein, 221 aa, Homo sapiens; identical to SEQ ID NO: 818529

SEQ ID NO: 818532 - protein, 172 aa, Homo sapiens
MLTLEDKDMKGFSWAIVPALTSLGYLIILVVSIFPFWVRLTNEESHEVFFSGLFENCFNAKCWKPRPLSRACAFLALVLHALEIKALRMKLGPLQFSVLWPYYVLGFGIFLFIVAGTICLIQEMVCPCWHLLSTSQSMEEDHGSLYLDNLESLGGEPSSVQKETQVTAETVI

SEQ ID NO: 818533 - protein, 224 aa, Homo sapiens
MEEIPAQEAAGSPRVQFQSLETQSECLSPEPQFVQDTDMEQGLTGAVPRASEFLPFFISESPPLAYIGSGATFYIILGRVFLLSAVFLAFVTTFIMMPFASEFFPRTWKQNFVLACISFFTGACAFLALVLHALEIKALRMKLGPLQFSVLWPYYVLGFGIFLFIVAGTICLIQEMVCPCWHLLSTSQSMEEDHGSLYLDNLESLGGEPSSVQKETQVTAETVI

SEQ ID NO: 818534 - protein, 516 aa, Homo sapiens
MIFILWPWCYSVLIPQSSQDVLFQEFVTFEDVAVHLTREEWGYLDPVQRDLYREVMLENYGNVVSLDGETREENKLLIPKQKISEEVHSYKVRVGRLKHDITQVPETREVYKSEDRLERLQEILRKFLYLEREFRQITISKETFTSEKNNECHEPEKSFSLDSTIDADQRVLRIQNTDDNDKYDMSFNQNSASGKHEHLNLTEDFQSSECKESLMDLSHLNKWESIPNTEKSYKCDVCGKIFHQSSALTRHQRIHTREKPYKCKECEKSFSQSSSLSRHKRIHTREKPYKCEASDKSCEASDKSCSPSSGIIQHKKIHTRAKSYKCSSCERVFSRSVHLTQHQKIHKEMPCKCTVCGSDFCHTSYLLEHQRVHHEEKAYEYDEYGLAYIKQQGIHFREKPYTCSECGKDFRLNSHLIQHQRIHTGEKAHECNECGKAFSQTSCLIQHHKMHRKEKSYEWQQLRPPGPVYVCTRRAPKPVSPRVLGEVSMDEVVGNNFVHPICNNFVHTDLCHHGFG

SEQ ID NO: 818535 - protein, 105 aa, Homo sapiens [sequence omitted]

SEQ ID NO: 818536 - protein, 236 aa, Homo sapiens; identical to SEQ ID NO: 818527

SEQ ID NO: 818537 - protein, 105 aa, Homo sapiens [sequence omitted]

SEQ ID NO: 818538 - protein, 258 aa, Homo sapiens
MLTLEDKDMKGFSWAIVPALTSLGYLIILVVSIFPFWVRLTNEESHEVFFSGLFENCFNAKCWKPRPLSIYIILGRVFLLSAVFLAFVTTFIMMPFASEFFPRTWKQNFVLACISFFTGACAFLALVLHALEIKALRMKLGPLQFSVLWPYYVLGFGIFLFIVAGPSALLKKWLAPCWNLVSPSQTTDEGPSHPVSALSWLVRQDTACGCLSDSFRRLSHTTDARHVLIPCPMIPHCPRFHPRLRPPLLATTPPDPTP

SEQ ID NO: 818539 - protein, 213 aa, Homo sapiens
MKLRQDQPALTHHGVMLTLEDKDMKGFSWAIVPALTSLGYLIILVVSIFPFWVRLTNEESHEVFFSGLFENCFNAKCWKPRPLSIYIILGRVFLLSAVFLAFVTTFIMMPFASEFFPRTWKQNFVLACISFFTGACAFLALVLHALEIKALRMKLGPLQFSVLWPYYVLGFGIFLFIVAGTICLIQEMVCPCWHLLSTPHTHSDSILLVCEIC

SEQ ID NO: 818540 - protein, 172 aa, Homo sapiens; identical to SEQ ID NO: 818532

SEQ ID NO: 818541 - protein, 105 aa, Homo sapiens [sequence omitted]

SEQ ID NO: 818542 - protein, 105 aa, Homo sapiens [sequence omitted]

SEQ ID NO: 818543 - protein, 105 aa, Homo sapiens [sequence omitted]

SEQ ID NO: 818544 - protein, 105 aa, Homo sapiens [sequence omitted]

SEQ ID NO: 818545 - protein, 626 aa, Homo sapiens
MSRSGAAAEKADSRQRPQMKVNEYKENQNIAYVSLRPAQTTVLIKTAKVYLAPFSLSNYQLDQLMCPKSLSEKNSNNEVACKKTKIKKTCRRIIPPKMKNTSSKAESTLQNSSSAVHTESNKLQPKRTADAMNLSVDVESSQDGDSDEDTTPALDFSGLSPYERKRLKNISENADFFASLQLSESAARLREMIEKRQPPKSKRKKPKRENGIGCRRSMRLLKVDPSGVSLPAAPTPPTLVADETPLLPPGPLEMTSENQEDNNERFKGFLHTWAGMSKPSSKNTEKGLSSIKSYKANLNGMVISEDTVYKVTTGPIFSMALHPSETRTLVAVGAKFGQVGLCDLTQQPKEDGVYVFHPHSQPVSCLYFSPANPAHILSLSYDGTLRCGDFSRAIFEEVYRNERSSFSSFDFLAEDASTLIVGHWDGNMSLVDRRTPGTSYEKLTSSSMGKIRTVHVHPVHRQYFITAGLRDTHIYDARRLNSRRSQPLISLTEHTKSIASAYFSPLTGNRVVTTCADCNLRIFDSSCISSKIPLLTTIRHNTFTGRWLTRFQAMWDPKQEDCVIVGSMAHPRRVEIFHETGKRVHSFGGEYLVSVCSINAMHPTRYILAGGNSSGKIHVFMNEKSC

SEQ ID NO: 818546 - protein, 553 aa, Homo sapiens
MSRSGAAAEKADSRQRPQMKVNEYKENQNIAYVSLRPAQTTVLIKTAKVYLAPFSLSNYQLDQLMCPKSLSEKNSNNEVACKKTKIKKTCRRIIPPKMKNTSSKAESTLQNSSSAVHTESNKLQPKRTADAMNLSVDVESSQDGDSDEDTTPALDFSGLSPYERKRLKNISENADFFASLQLSESAARLREMIEKRQPPKSKRKKPKRENGIGCRRSMRLLKVDPSGVSLPAAPTPPTLVADETPLLPPGPLEMTSENQEDNNERFKGFLHTWAGMSKPSSKNTEKGLSSIKSYKANLNGMVISEDTVYKVTTGPIFSMALHPSETRTLVAVGAKFGQVGLCDLTQQPKEDGVYVFHPHSQPVSCLYFSPANPAHILSLSYDGTLRCGDFSRAIFEEVYRNERSSFSSFDFLAEDASTLIVGHWDGNMSLVDRRTPGTSYEKLTSSSMGKIRTVHVHPVHRQYFITAGLRDTHIYDARRLNSRRSQPLISLTEHTKSIASAYFSPLTGNRVVTTCADCNLRIFDSSCISSKIPLLTTISHHAWPSELVIKTVC

SEQ ID NO: 818547 - protein, 562 aa, Homo sapiens
MCPKSLSEKNSNNEVACKKTKIKKTCRRIIPPKMKNTSSKAESTLQNSSSAVHTESNKLQPKRTADAMNLSVDVESSQDGDSDEDTTPALDFSGLSPYERKRLKNISENADFFASLQLSESAARLREMIEKRQPPKSKRKKPKRENGIGCRRSMRLLKVDPSGVSLPAAPTPPTLVADETPLLPPGPLEMTSENQEDNNERFKGFLHTWAGMSKPSSKNTEKGLSSIKSYKANLNGMVISEDTVYKVTTGPIFSMALHPSETRTLVAVGAKFGQVGLCDLTQQPKEDGVYVFHPHSQPVSCLYFSPANPAHILSLSYDGTLRCGDFSRAIFEEVYRNERSSFSSFDFLAEDASTLIVGHWDGNMSLVDRRTPGTSYEKLTSSSMGKIRTVHVHPVHRQYFITAGLRDTHIYDARRLNSRRSQPLISLTEHTKSIASAYFSPLTGNRVVTTCADCNLRIFDSSCISSKIPLLTTIRHNTFTGRWLTRFQAMWDPKQEDCVIVGSMAHPRRVEIFHETGKRVHSFGGEYLVSVCSINAMHPTRYILAGGNSSGKIHVFMNEKSC

SEQ ID NO: 818548 - protein, 562 aa, Homo sapiens; identical to SEQ ID NO: 818547

SEQ ID NO: 818549 - protein, 540 aa, Homo sapiens
MSRSGAAAEKADSRQRPQMKVNEYKENQNIAYVSLRPAQTTVLIKTAKVYLAPFSLSNYQLDQLMCPKSLSEKNSNNEVACKKTKIKKTCRRIIPPKMKNTSSKAESTLQNSSSAVHTESNKLQPKRTADAMNLSVDVESSQDGDSDEDTTPALDFSGLSPYERKRLKNISENADFFASLQLSESAARLREMIEKRQPPKSKRKKPKRENGIGCRRSMRLLKVDPSGVSLPAAPTPPTLVADETPLLPPGPLEMTSENQEDNNERFKGFLHTWAGMSKPSSKNTEKGLSSIKSYKANLNGMVISEDTVYKVTTGPIFSMALHPSETRTLVAVGAKFGQVGLCDLTQQPKEDGVYVFHPHSQPVSCLYFSPANPAHILSLSYDGTLRCGDFSRAIFEEVYRNERSSFSSFDFLAEDASTLIVGHWDGNMSLVDRRTPGTSYEKLTSSSMGKIRTVHVHPVHRQYFITAGLRDTHIYDARRLNSRRSQPLISLTEHTKSIASAYFSPLTGNRVVTTCADCNLRIFDSSCISSKIPLLTTISR

SEQ ID NO: 818550 - protein, 347 aa, Homo sapiens
MSRSGAAAEKADSRQRPQMKVNEYKENQNIAYVSLRPAQTTVLIKTAKVYLAPFSLSNYQLDQLMCPKSLSEKNSNNEVACKKTKIKKTCRRIIPPKMKNTSSKAESTLQNSSSAVHTESNKLQPKRTADAMNLSVDVESSQDGDSDEDTTPALDFSGLSPYERKRLKNISENADFFASLQLSESAARLREMIEKRQPPKSKRKKPKRENGIGCRRSMRLLKVDPSGVSLPAAPTPPTLVADETPLLPPGPLEMTSENQEDNNERFKGFLHTWAGMSKPSSKNTEKGLSSIKSYKANLNGMVISEDTVYKVTTGPIFSMALHPSETRTLVAVGAKFGQVGLCDLVSY

SEQ ID NO: 818551 - protein, 180 aa, Homo sapiens
MFSPVVEVHYMYYGNIDHCFSHYRDTHIYDARRLNSRRSQPLISLTEHTKSIASAYFSPLTGNRVVTTCADCNLRIFDSSCISSKIPLLTTIRHNTFTGRWLTRFQAMWDPKQEDCVIVGSMAHPRRVEIFHETGKRVHSFGGEYLVSVCSINAMHPTRYILAGGNSSGKIHVFMNEKSC

SEQ ID NO: 818552 - protein, 325 aa, Homo sapiens
MPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKVPRSPRWGLLLEMERGWPHPIGTCGLPLGSPPS

SEQ ID NO: 818553 - protein, 347 aa, Homo sapiens [sequence omitted]

SEQ ID NO: 818554 - protein, 698 aa, Homo sapiens
GESQWRRLRNLGECTEELRERTRDQDQAETRGASPGRGSGSRPEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKLQPWVNMCDLASESLGRISDPLPLPGSGIQVSDTAIRGSGCRSLPGVLTPLDRLPEFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 818555 - protein, 347 aa, Homo sapiens [sequence omitted]

SEQ ID NO: 818556 - protein, 347 aa, Homo sapiens [sequence omitted]

SEQ ID NO: 818557 - protein, 409 aa, Homo sapiens
GPAGARPRKAGVERRAEPAGPGLHHGQRPGPAPPRQPGSFCWALKADGIMWLAKACWSIQSEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEGVWLGCGPAGQG

SEQ ID NO: 818558 - protein, 391 aa, Homo sapiens
GESQWRRLRNLGECTEELRERTRDQDQAETRGASPGRGSGSRPEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEGVWLGCGPAGQG

SEQ ID NO: 818559 - protein, 213 aa, Homo sapiens
MFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 818560 - protein, 213 aa, Homo sapiens; identical to SEQ ID NO: 818559

SEQ ID NO: 818561 - protein, 220 aa, Homo sapiens
RVSPAGPLCGSLCGIAVWHFEDNYTFGQPGPQRATLQVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 818562 - protein, 391 aa, Homo sapiens; identical to SEQ ID NO: 818558

SEQ ID NO: 818563 - protein, 391 aa, Homo sapiens; identical to SEQ ID NO: 818558

SEQ ID NO: 818564 - protein, 369 aa, Homo sapiens
GESQWRRLRNLGECTEELRERTRDQDQAETRGASPGRGSGSRPEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKVPRSPRWGLLLEMERGWPHPIGTCGLPLGSPPS

SEQ ID NO: 818565 - protein, 110 aa, Homo sapiens
MPCIQAQYGTPAPSPGPRDHLASDPLTPEFIKPTMDLASPEAAPAAPTALPSFSTFMDGYTGEFDTFLYQLPGTVQPCSSASSSASSTSSSSAVHLEVLELEGGRAGEVA

SEQ ID NO: 818566 - protein, 642 aa, Homo sapiens
GESQWRRLRNLGECTEELRERTRDQDQAETRGASPGRGSGSRPEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 818567 - protein, 391 aa, Homo sapiens; identical to SEQ ID NO: 818558

SEQ ID NO: 818568 - protein, 331 aa, Homo sapiens
MPCIQAQYGTPAPSPGPRDHLASDPLTPEFINALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEGVWLGCGPAGQG

SEQ ID NO: 818569 - protein, 347 aa, Homo sapiens [sequence omitted]

SEQ ID NO: 818570 - protein, 245 aa, Homo sapiens
MKEMGVRAGREDVVGPACKRVGVVCSSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEGVWLGCGPAGQG

SEQ ID NO: 818571 - protein, 213 aa, Homo sapiens; identical to SEQ ID NO: 818559

SEQ ID NO: 818572 - protein, 325 aa, Homo sapiens
GESQWRRLRNLGECTEELRERTRDQDQAETRGASPGRGSGSRPGRFPSGNVHLFLGAVHEGDGCTRGQRGCCEGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 818573 - protein, 100 aa, Homo sapiens
LLLVVSSQDRKSKSMQEYSSVRKKMPGQTMEVAHTCNPHTLGGRGMEDHLSLGARDQAWANMAETLSVQKYRKLVSVVVLACGPSYLEYEDNEGYCFSDL

SEQ ID NO: 818574 - protein, 391 aa, Homo sapiens; identical to SEQ ID NO: 818558

SEQ ID NO: 818575 - protein, 391 aa, Homo sapiens; identical to SEQ ID NO: 818558

SEQ ID NO: 818576 - protein, 83 aa, Homo sapiens
RRVPFRPPVLWVPRTARIFGREDRNAVCECGPRAPVASRKHLFPASCLAQGPTGICPYVDRKLIFIKSSQRSGSIQCQQQMEV

SEQ ID NO: 818577 - protein, 583 aa, Homo sapiens
MPKPINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAM

SEQ ID NO: 818578 - protein, 583 aa, Homo sapiens; identical to SEQ ID NO: 818577

SEQ ID NO: 818579 - protein, 583 aa, Homo sapiens; identical to SEQ ID NO: 818577

SEQ ID NO: 818580 - protein, 565 aa, Homo sapiens
MPKPINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTANEGVMNHRSEEERVTETQKNERVKKQLQALSSELAQARDETKKTQNDVLHAENVKAGRDKYKTLRQIRQGNTKQRIDEFEAM

SEQ ID NO: 818581 - protein, 572 aa, Homo sapiens
MDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAM

SEQ ID NO: 818582 - protein, 77 aa, Homo sapiens
RISSGGVFYYQKLHYIRIQTHDPLLKTDTPLELLGFLVSSFGGAMTLPAALACHPCFVVSPDTHSQQVLLNLLPESC

SEQ ID NO: 818583 - protein, 583 aa, Homo sapiens; identical to SEQ ID NO: 818577

SEQ ID NO: 818584 - protein, 583 aa, Homo sapiens; identical to SEQ ID NO: 818577

SEQ ID NO: 818585 - protein, 583 aa, Homo sapiens; identical to SEQ ID NO: 818577

SEQ ID NO: 818586 - protein, 156 aa, Homo sapiens
MPKPINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQR

SEQ ID NO: 818587 - protein, 1217 aa, Homo sapiens
MYIKQVIIQGFRSYRDQTIVDPFSSKHNVIVGRNGSGKSNFFYAIQFVLSDEFSHLRPEQRLALLHEGTGPRVISAFVEIIFDNSDNRLPIDKEEVSLRRVIGAKKDQYFLDKKMVTKNDVMNLLESAGFSRSNPYYIVKQGKINQMATAPDSQRLKLLREVAGTRVYDERKEESISLMKETEGKREKINELLKYIEERLHTLEEEKEELAQYQKWDKMRRALEYTIYNQELNETRAKLDELSAKRETSGEKSRQLRDAQQDARDKMEDIERQVRELKTKISAMKEEKEQLSAERQEQIKQRTKLELKAKDLQDELAGNSEQRKRLLKERQKLLEKIEEKQKELAETEPKFNSVKEKEERGIARLAQATQERTDLYAKQGRGSQFTSKEERDKWIKKELKSLDQAINDKKRQIAAIHKDLEDTEANKEKNLEQYNKLDQDLNEVKARVEELDRKYYEVKNKKDELQSERNYLWREENAEQQALAAKREDLEKKQQLLRAATGKAILNGIDSINKVLDHFRRKGINQHVQNGYHGIVMNNFECEPAFYTCVEVTAGNRLFYHIVDSDEVSTKILMEFNKMNLPGEVTFLPLNKLDVRDTAYPETNDAIPMISKLRYNPRFDKAFKHVFGKTLICRSMEVSTQLARAFTMDCITLEGDQVSHRGALTGGYYDTRKSRLELQKDVRKAEEELGELEAKLNENLRRNIERINNEIDQLMNQMQQIETQQRKFKASRDSILSEMKMLKEKRQQSEKTFMPKQRSLQSLEASLHAMESTRESLKAELGTDLLSQLSLEDQKRVDALNDEIRQLQQENRQLLNERIKLEGIITRVETYLNENLRKRLDQVEQELNELRETEGGTVLTATTSELEAINKRVKDTMARSEDLDNSIDKTEAGIKELQKSMERWKNMEKEHMDAINHDTKELEKMTNRQGMLLKKKEECMKKIRELGSLPQEAFEKYQTLSLKQLFRKLEQCNTELKKYSHVNKKALDQFVNFSEQKEKLIKRQEELDRGYKSIMELMNVLELRKYEAIQLTFKQVSKNFSEVFQKLVPGGKATLVMKKGDVEGSQSQDEGEGSGESERGSGSQSSVPSVDQFTGVGIRVSFTGKQGEMREMQQLSGGQKSLVALALIFAIQKCDPAPFYLFDEIDQALDAQHRKAVSDMIMELAVHAQFITTTFRPELLESADKFYGVKFRNKVSHIDVITAEMAKDFVEDDTTHG

SEQ ID NO: 818588 - protein, 308 aa, Homo sapiens
RPRAGRAVWSCRGGLTRPMCLGCVERWLPRPGGGPGGIGWGVVTCHCGEPFLSPVNPRSERDPPACRIRSAASLGCLLLSKWSSRAGLHHKDEPRHTALETVFCWVIIQGFRSYRDQTIVDPFSSKHNVIVGRNGSGKSNFFYAIQFVLSDEFSHLRPEQRLALLHEGTGPRVISAFVEIIFDNSDNRLPIDKEEVSLRRVIGAKKDQYFLDKKMVTKNDVMNLLESAGFSRSNPYYIVKQGKINQMATAPDSQRLKLLREVAGTRVYDERKEESISLMKETEGKRGKNQSAVPMSSRKLSYVKGNKT

SEQ ID NO: 818589 - protein, 126 aa, Homo sapiens
RPRAGRAVWSCRGGLTRPMCLGCVERWLPRPGGGPGGIGWGVVTCHCGEPFLSPVNPRSERDPPACRIRSAASLGCLLLSKWSSRAGLHHKDEPRHTALETVFCWVCRALSTPSLERGFFQAGRRE

SEQ ID NO: 818590 - protein, 1217 aa, Homo sapiens; identical to SEQ ID NO: 818587

SEQ ID NO: 818591 - protein, 1213 aa, Homo sapiens
LTGGYYDTRKSRLELQKDVRKAEEELGELEAKLNERIKLEGIITRVETYLNENLRKRLDQVEQELNELRETEGGTVLTATTSELEAINKRVKDTMARSEDLDNSIDKTEAGIKELQKSMERWKNMEKEHMDAINHDTERINQMATAPDSQRLKLLREVAGTRVYDERKEESISLMKETEGKREKINELLKYIEERLHTLEEEKEELAQYQKWDKMRRALEYTIYNQELNETRAKLDELSAKRETSGEKSRQLRDAQQDARDKMEDIERQVRELKTKISAMKEEKEQLSAERQEQIKQRTKLELKAKDLQDELAGNSEQRKRLLKERQKLLEKIEEKQKELAETEPKFNSVKEKEERGIARLAQATQERTDLYAKQGRGSQFTSKEERDKWIKKELKSLDQAINDKKRQIAAIHKDLEDTEANKEKNLEQYNKLDQDLNEVKARVEELDRKYYEVKNKKDELQSERNYLWREENAEQQALAAKREDLEKKQQLLRAATGKAILNGIDSINKVLDHFRRKGINQHVQNGYHGIVMNNFECEPAFYTCVEVTAGNRLFYHIVDSDEVSTKILMEFNKMNLPGEVTFLPLNKLDVRDTAYPETNDAIPMISKLRYNPRFDKAFKHVFGKTLICRSMEVSTQLARAFTMDCITLEGDQVSHRGALTGGYYDTRKSRLELQKDVRKAEEELGELEAKLNENLRRNIERINNEIDQLMNQMQQIETQQRKFKASRDSILSEMKMLKEKRQQSEKTFMPKQRSLQSLEASLHAMESTRESLKAELGTDLLSQLSLEDQKRVDALNDEIRQLQQENRQLLNERIKLEGIITRVETYLNENLRKRLDQVEQELNELRETEGGTVLTATTSELEAINKRVKDTMARSEDLDNSIDKTEAGIKELQKSMERWKNMEKEHMDAINHDTKELEKMTNRQGMLLKKKEECMKKIRELGSLPQEAFEKYQTLSLKQLFRKLEQCNTELKKYSHVNKKALDQFVNFSEQKEKLIKRQEELDRGYKSIMELMNVLELRKYEAIQLTFKQVSKNFSEVFQKLVPGGKATLVMKKGDVEGSQSQDEGEGSGESERGSGSQSSVPSVDQFTGVGIRVSFTGKQGEMREMQQLSGGQKSLVALALIFAIQKCDPAPFYLFDEIDQALDAQHRKAVSDMIMELAVHAQFITTTFRPELLESADKFYGVKFRNKVSHIDVITAEMAKDFVEDDTTHG

SEQ ID NO: 818592 - protein, 564 aa, Homo sapiens
MYIKQVIIQGFRSYRDQTIVDPFSSKHNVIVGRNGSGKSNFFYAIQFVLSDEFSHLRPEQRLALLHEGTGPRVISAFVEIIFDNSDNRLPIDKEEVSLRRVIGAKKDQYFLDKKMVTKNDVMNLLESAGFSRSNPYYIVKQGKINQMATAPDSQRLKLLREVAGTRVYDERKEESISLMKETEGKREKINELLKYIEERLHTLEEEKEELAQYQKWDKMRRALEYTIYNQELNETRAKLDELSAKRETSGEKSRQLRDAQQDARDKMEDIERQVRELKTKISAMKEEKEQLSAERQEQIKQRTKLELKAKDLQDELAGNSEQRKRLLKERQKLLEKIEEKQKELAETEPKFNSVKEKEERGIARLAQATQERTDLYAKQGRGSQFTSKEERDKWIKKELKSLDQAINDKKRQIAAIHKDLEDTEANKEKNLEQYNKLDQDLNEVKARVEELDRKYYEVKNKKDELQSERNYLWREENAEQQALAAKREDLEKKQQLLRAATGKAILNGIDSINKVLDHFRRKGINQHVQNGYHGIVMNNFECEPAFYTCVEVTAGNRLKLLLDI

SEQ ID NO: 818593 - protein, 898 aa, Homo sapiens
LTGGYYDTRKSRLEIEKIEEKQKELAETEPKFNSVKEKEERGIARLAQATQERTDLYAKQGRGSQFTSKEERDKWIKKELKSLDQAINDKKRQIAAIHKDLEDTEANKEKNLEQYNKLDQDLNEVKARVEELDRKYYEVKNKKDELQSERNYLWREENAEQQALAAKREDLEKKQQLLRAATGKAILNGIDSINKVLDHFRRKGINQHVQNGYHGIVMNNFECEPAFYTCVEVTAGNRLFYHIVDSDEVSTKILMEFNKMNLPGEVTFLPLNKLDVRDTAYPETNDAIPMISKLRYNPRFDKAFKHVFGKTLICRSMEVSTQLARAFTMDCITLEGDQVSHRGALTGGYYDTRKSRLELQKDVRKAEEELGELEAKLNENLRRNIERINNEIDQLMNQMQQIETQQRKFKASRDSILSEMKMLKEKRQQSEKTFMPKQRSLQSLEASLHAMESTRESLKAELGTDLLSQLSLEDQKRVDALNDEIRQLQQENRQLLNERIKLEGIITRVETYLNENLRKRLDQVEQELNELRETEGGTVLTATTSELEAINKRVKDTMARSEDLDNSIDKTEAGIKELQKSMERWKNMEKEHMDAINHDTKELEKMTNRQGMLLKKKEECMKKIRELGSLPQEAFEKYQTLSLKQLFRKLEQCNTELKKYSHVNKKALDQFVNFSEQKEKLIKRQEELDRGYKSIMELMNVLELRKYEAIQLTFKQVSKNFSEVFQKLVPGGKATLVMKKGDVEGSQSQDEGEGSGESERGSGSQSSVPSVDQFTGVGIRVSFTGKQGEMREMQQLSGGQKSLVALALIFAIQKCDPAPFYLFDEIDQALDAQHRKAVSDMIMELAVHAQFITTTFRPELLESADKFYGVKFRNKVSHIDVITAEMAKDFVEDDTTHG

SEQ ID NO: 818594 - protein, 899 aa, Homo sapiens
DLNEVKARVEELDRKYYEVKNKKDELAETEPKFNSVKEKEERGIARLAQATQERTDLYAKQGRGSQFTSKEERDKWIKKELKSLDQAINDKKRQIAAIHKDLEDTEANKEKNLEQYNKLDQDLNEVKARVEELDRKYYEVKNKKDELQSERNYLWREENAEQQALAAKREDLEKKQQLLRAATGKAILNGIDSINKVLDHFRRKGINQHVQNGYHGIVMNNFECEPAFYTCVEVTAGNRLFYHIVDSDEVSTKILMEFNKMNLPGEVTFLPLNKLDVRDTAYPETNDAIPMISKLRYNPRFDKAFKHVFGKTLICRSMEVSTQLARAFTMDCITLEGDQVSHRGALTGGYYDTRKSRLELQKDVRKAEEELGELEAKLNENLRRNIERINNEIDQLMNQMQQIETQQRKFKASRDSILSEMKMLKEKRQQSEKTFMPKQRSLQSLEASLHAMESTRESLKAELGTDLLSQLSLEDQKRVDALNDEIRQLQQENRQLLNERIKLEGIITRVETYLNENLRKRLDQVEQELNELRETEGGTVLTATTSELEAINKRVKDTMARSEDLDNSIDKTEAGIKELQKSMERWKNMEKEHMDAINHDTKELEKMTNRQGMLLKKKEECMKKIRELGSLPQEAFEKYQTLSLKQLFRKLEQCNTELKKYSHVNKKALDQFVNFSEQKEKLIKRQEELDRGYKSIMELMNVLELRKYEAIQLTFKQVSKNFSEVFQKLVPGGKATLVMKKGDVEGSQSQDEGEGSGESERGSGSQSSVPSVDQFTGVGIRVSFTGKQGEMREMQQLSGGQKSLVALALIFAIQKCDPAPFYLFDEIDQALDAQHRKAVSDMIMELAVHAQFITTTFRPELLESADKFYGVKFRNKVSHIDVITAEMAKDFVEDDTTHG

SEQ ID NO: 818595 - protein, 690 aa, Homo sapiens
MYIKQVIIQGFRSYRDQTIVDPFSSKHNVIVGRNGSGKSNFFYAIQFVLSDEFSHLRPEQRLALLHEGTGPRVISAFVEIIFDNSDNRLPIDKEEVSLRRVIGAKKDQYFLDKKMVTKNDVMNLLESAGFSRSNPYYIVKQGKINQMATAPDSQRLKLLREVAGTRVYDERKEESISLMKETEGKREKINELLKYIEERLHTLEEEKEELAQYQKWDKMRRALEYTIYNQELNETRAKLDELSAKRETSGEKSRQLRDAQQDARDKMEDIERQVRELKTKISAMKEEKEQLSAERQEQIKQRTKLELKAKDLQDELAGNSEQRKRLLKERQKLLEKIEEKQKELAETEPKFNSVKEKEERGIARLAQATQERTDLYAKQGRGSQFTSKEERDKWIKKELKSLDQAINDKKRQIAAIHKDLEDTEANKEKNLEQYNKLDQDLNEVKARVEELDRKYYEVKNKKDELQSERNYLWREENAEQQALAAKREDLEKKQQLLRAATGKAILNGIDSINKVLDHFRRKGINQHVQNGYHGIVMNNFECEPAFYTCVEVTAGNRLFYHIVDSDEVSTKILMEFNKMNLPGEVTFLPLNKLDVRDTAYPETNDAIPMISKLRYNPRFDKAFKHVFGKTLICRSMEVSTQLARAFTMDCITLEGDQVSHRGALTGGYYDTRKSRLELQKDVRKAERRTR

SEQ ID NO: 818596 - protein, 564 aa, Homo sapiens; identical to SEQ ID NO: 818592

SEQ ID NO: 818597 - protein, 415 aa, Homo sapiens
SSSGTITDEDELTGILKKLSLEKYQPIFEEQEVDMEAFLTLTDGDLKELGIKTDGPRQQCAIETSKTGLVLEVSIARSEDLDNSIDKTEAGIKELQKSMERWKNMEKEHMDAINHDTKELEKMTNRQGMLLKKKEECMKKIRELGSLPQEAFEKYQTLSLKQLFRKLEQCNTELKKYSHVNKKALDQFVNFSEQKEKLIKRQEELDRGYKSIMELMNVLELRKYEAIQLTFKQVSKNFSEVFQKLVPGGKATLVMKKGDVEGSQSQDEGEGSGESERGSGSQSSVPSVDQFTGVGIRVSFTGKQGEMREMQQLSGGQKSLVALALIFAIQKCDPAPFYLFDEIDQALDAQHRKAVSDMIMELAVHAQFITTTFRPELLESADKFYGVKFRNKVSHIDVITAEMAKDFVEDDTTHG

SEQ ID NO: 818598 - protein, 208 aa, Homo sapiens
MYIKQVIIQGFRSYRDQTIVDPFSSKHNVIVGRNGSGKSNFFYAIQFVLSDEFSHLRPEQRLALLHEGTGPRVISAFVEIIFDNSDNRLPIDKEEVSLRRVIGAKKDQYFLDKKMVTKNDVMNLLESAGFSRSNPYYIVKQGKINQMATAPDSQRLKLLREVAGTRVYDERKEESISLMKETEGKRGKNQSAVPMSSRKLSYVKGNKT

SEQ ID NO: 818599 - protein, 43 aa, Homo sapiens
MPVARSWVCRKTYVTPRRPFEKSRLDQELKLIGEYGLRNKREV

SEQ ID NO: 818600 - protein, 361 aa, Homo sapiens
MEQPQEEAPEVREEEEKEEVAEAEGAPELNGGPQHALPSSSYTDLSRSSSPPSLLDQLQMGCDGASCGSLNMECRVCGDKASGFHYGVHACEGCKGFFRRTIRMKLEYEKCERSCKIQKKNRNKCQYCRFQKCLALGMSHNAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGGE

SEQ ID NO: 818601 - protein, 135 aa, Homo sapiens
LQPVHYAWLLAWLFAWLFAWHLAWLVAWPLVWHLAWLFAWLLVWLFGWLFAGALWQAEKGLVWKQLVNGLPPYKEISVHVFYRCQCTTVETVRELTEFAKSIPSFSSLFLNDQVTLLKGPHKEPPNVPGSSRTAP

SEQ ID NO: 818602 - protein, 441 aa, Homo sapiens
MEQPQEEAPEVREEEEKEEVAEAEGAPELNGGPQHALPSSSYTDLSRSSSPPSLLDQLQMGCDGASCGSLNMECRVCGDKASGFHYGVHACEGCKGFFRRTIRMKLEYEKCERSCKIQKKNRNKCQYCRFQKCLALGMSHNAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGDRPGLMNVPRVEAIQDTILRALEFHLQANHPDAQYLFPKLLQKMADLRQLVTEHAQMMQRIKKTETETSLHPLLQEIYKDMY

SEQ ID NO: 818603 - protein, 441 aa, Homo sapiens; identical to SEQ ID NO: 818602

SEQ ID NO: 818604 - protein, 441 aa, Homo sapiens; identical to SEQ ID NO: 818602

SEQ ID NO: 818605 - protein, 441 aa, Homo sapiens; identical to SEQ ID NO: 818602

SEQ ID NO: 818606 - protein, 441 aa, Homo sapiens; identical to SEQ ID NO: 818602

SEQ ID NO: 818607 - protein, 441 aa, Homo sapiens; identical to SEQ ID NO: 818602

SEQ ID NO: 818608 - protein, 294 aa, Homo sapiens [sequence omitted]

SEQ ID NO: 818609 - protein, 113 aa, Homo sapiens
MHQRGVGGSHQESEQCSGFPLLFPCSQDAWQVFPLPPCPVAAAHIVSASRARAWPHIPLLLSLAGSTGVQAPLPLKLPLQHTHISTEITLPAGSMHLPSLPEAGENPERGACR

SEQ ID NO: 818610 - protein, 108 aa, Homo sapiens
QSPNSAQSPNSAQSPNSAQSPNSAQSPNSAFAPRTRGLSPGVRPGRARGRPSASTPTAPLPSSSRPHCVSIQGQGLASHPPAPFSSWLHGSSGPTPPEAAPPAHTHKH

SEQ ID NO: 818611 - protein, 361 aa, Homo sapiens; identical to SEQ ID NO: 818600

SEQ ID NO: 818612 - protein, 830 aa, Homo sapiens
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCNNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 818613 - protein, 830 aa, Homo sapiens; identical to SEQ ID NO: 818612

SEQ ID NO: 818614 - protein, 790 aa, Homo sapiens
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCNNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQDDGKCPLNPHSHLGTYGVFTNAAFDPSP

SEQ ID NO: 818615 - protein, 178 aa, Homo sapiens
MYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 818616 - protein, 204 aa, Homo sapiens
PEAGGAVRRAEAVVRIMGGGWWWARAARLARLRFRRSLLPPQRPRSGGARGSFAPGHGPRAGASPPPVSELDRADAWLLRKAHETAFLSWFRNGLLASGIGVISFMQSDMGREAAYGFFLLGGLCVVWGSASYAVGLAALRGPMQLTLGGAAVGAGAVLAASLLWACAVGLYMGQLELDVELVPEDDGTASAEGPDEAGRPPPE

SEQ ID NO: 818617 - protein, 204 aa, Homo sapiens; identical to SEQ ID NO: 818616

SEQ ID NO: 818618 - protein, 139 aa, Homo sapiens
TWLWSPPLRSDSQRCRLAPGTALPLFLSPQPWLCSQTIPRPWPCCYPASPAGFFLLGGLCVVWGSASYAVGLAALRGPMQLTLGGAAVGAGAVLAASLLWACAVGLYMGQLELDVELVPEDDGTASAEGPDEAGRPPPE

SEQ ID NO: 818619 - protein, 157 aa, Homo sapiens
PEAGGAVRRAEAVVRIMGGGWWWARAARLARLRFRRSLLPPQRPRSGGARGSFAPGHGPRAGASPPPVSELDRADAWLLRKAHETAFLSWFRNGLLASGIGVISFMQTDAGGRGRGRGRRAGRQPALGVRRGPLHGAAGAGRGAGARGRRDGLRGRP

SEQ ID NO: 818620 - protein, 706 aa, Homo sapiens
MAVPAALIPPTQLVPPQPPISTSASSSGTTTSTSSATSSPAPSIGPPASSGPTLFRPEPIASAAAAAATVTSTGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIPVHQNGLSMNQMLMGLSPNVLPGPKEGDLAGHDMGHESKRMHIEKDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 818621 - protein, 706 aa, Homo sapiens; identical to SEQ ID NO: 818620

SEQ ID NO: 818622 - protein, 229 aa, Homo sapiens
PHPAHPPPPLLSVSHIPPRCSRPGRPPKRTQSVTSPENSHIMPHSVPGLMSPGIIPPTGLTAAAAAAAAATNAAIAEAMKVKKIKLEAMSNYHASNNQHGADSENGDMNSSVGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIRRSHTSTCHHFKLY

SEQ ID NO: 818623 - protein, 706 aa, Homo sapiens; identical to SEQ ID NO: 818620

SEQ ID NO: 818624 - protein, 661 aa, Homo sapiens
MAVPAALIPPTQLVPPQPPISTSASSSGTTTSTSSATSSPAPSIGPPASSGPTLFRPEPIASAAAAAATVTSTGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIHETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 818625 - protein, 674 aa, Homo sapiens
MAVPAALIPPTQLVPPQPPISTSASSSGTTTSTSSATSSPAPSIGPPASSGPTLFRPEPIASAAAAAATVTSTGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIPVHQNGLSMNQMLMGLSPNVLPGPKEGDLAGHDMGHESKRMHIEKDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNGIK

SEQ ID NO: 818626 - protein, 405 aa, Homo sapiens
REAALALESDGSAVAAANTVCLTAAAAAAAAATNAAIAEAMKVKKIKLEAMSNYHASNNQHGADSENGDMNSSVGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIPVHQNGLSMNQMLMGLSPNVLPGPKEGDLAGHDMGHESKRMHIEKDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 818627 - protein, 492 aa, Homo sapiens
MAVPAALIPPTQLVPPQPPISTSASSSGTTTSTSSATSSPAPSIGPPASSGPTLFRPEPIASAAAAAATVTSTGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIRRSHTSTCHHFKLY

SEQ ID NO: 818628 - protein, 126 aa, Homo sapiens
GSSFQIARSASPTRRMLPTTARRMVMALGVFPHSWLSGSCLSPSTTGGSLQSFRASDPGPAMKWLQIHYTESLSPRTLWTSPSTSSTNPTMALWTDVSFSEGLERGSDEKVRLKRLARLLGLITAP

SEQ ID NO: 818629 - protein, 799 aa, Homo sapiens
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 818630 - protein, 817 aa, Homo sapiens
RQSLTLSPRLECSGEISTHYNLCLLGSSDSPASASRIAGITGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 818631 - protein, 815 aa, Homo sapiens
SLTLLPRLECSGAISGHRNLCLPGSSDSPASASRVAGITGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 818632 - protein, 836 aa, Homo sapiens
MRRYRHDPRTCSPSRSLATAFGPSNLGSPNTACPAPFPWRRAAKQRELGSTQWFRAPHAPSLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 818633 - protein, 799 aa, Homo sapiens; identical to SEQ ID NO: 818629

SEQ ID NO: 818634 - protein, 754 aa, Homo sapiens
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 818635 - protein, 769 aa, Homo sapiens
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 818636 - protein, 619 aa, Homo sapiens
IADSRGSPSSPPTSRGDQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 818637 - protein, 649 aa, Homo sapiens
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGSANARSRGPLGRCVRSAPPARMHAAPREIASSACCSTLGNLTTRPATAYAGMR

SEQ ID NO: 818638 - protein, 701 aa, Homo sapiens
RQSLTLSPRLECSGEISTHYNLCLLGSSDSPASASRIAGITGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 818639 - protein, 450 aa, Homo sapiens
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEVRQLLLCQEQGSPLLRPWRVSLRGMQVPCRLHRGQL

SEQ ID NO: 818640 - protein, 843 aa, Homo sapiens
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTIKFQMKKVLCLAVAVGHVKMTDDELVYNIHLAVNFLVSLLKKNWQNVRALYIKSTMGKPQRLY

SEQ ID NO: 818641 - protein, 446 aa, Homo sapiens
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTHLFEVSLEPLRIKINNRDVFDHADQ

SEQ ID NO: 818642 - protein, 229 aa, Homo sapiens
SECDKCFSRSTNLIRHRRTHTGEKPFKCLECEKAFSGKSDLISHQRTHTGERPYKCNKCEKSYRHRSAFIVHKRVHTGEKPYKCGACEKCFGQKSDLIVHQRVHTGEKPYKCLECMRSFTRSANLIRHQATHTHTFKCLEYEKSFNCSSDLIVHQRIHMEEKPHQWSACESGFLLGMDFVAQQKMRTQTEELHYKYTVCDKSFHQSSALLQHQTVHIGEKGLNSGGATL

SEQ ID NO: 818643 - protein, 245 aa, Homo sapiens
SECDKCFSRSTNLIRHRRTHTGEKPFKCLECEKAFSGKSDLISHQRTHTGERPYKCNKCEKSYRHRSAFIVHKRVHTGEKPYKCGACEKCFGQKSDLIVHQRVHTGEKPYKCLECMRSFTRSANLIRHQATHTHTFKCLEYEKSFNCSSDLIVHQRIHMEEKPHQWSACESGFLLGMDFVAQQKMRTQTEELHYKYTVCDKSFHQSSALLQHQTVHIGEKPFVCNVSEKGLELSPPHASEASQMS

SEQ ID NO: 818644 - protein, 245 aa, Homo sapiens; identical to SEQ ID NO: 818643

SEQ ID NO: 818645 - protein, 245 aa, Homo sapiens; identical to SEQ ID NO: 818643

SEQ ID NO: 818646 - protein, 72 aa, Homo sapiens
FCGDLEDPELFCGEGFERSMMTCEDINECAQNPLLCAFRCVNTYGSYECKCPVGYVLREDRRMCKDEDEWMK

SEQ ID NO: 818647 - protein, 359 aa, Homo sapiens
MSPDYQHIRLLDNNECTSDINLCGSKGICQNTPGSFTCECQRGFSLDQTGSSCEDVDECEGNHRCQHGCQNIIGGYRCSCPQGYLQHYQWNQCVDENECLSAHICGGASCHNTLGSYKCMCPAGFQYEQFSGGCQDINECGSAQAPCSYGCSNTEGGYLCGCPPGYFRIGQGHCVSGMGMGRGNPEPPVSGEMDDNSLSPEACYECKINGYPKRGRKRRSTNETDASNIEDQSETEANVSLASWDVEKTAIFAFNISHVSNKVRILELLPALTTLTNHNRYLIESGNEDGFFKINQKEGISYLHFTKKKPVAGTYSLQISSTPLYKKKELNQLEDKYDKDYLSGELGDNLKMKIQVLLH

SEQ ID NO: 818648 - protein, 240 aa, Homo sapiens [sequence omitted]

SEQ ID NO: 818649 - protein, 103 aa, Homo sapiens
MRRGRLLEIALGFTVLLASYTSHGADANLEAGNVKETRASRAKRRGGGGHDALKGIAPVYKGRGDLILWLKICREVGGLVRHLSHFSGLSPTSVFPWECEKRN

SEQ ID NO: 818650 - protein, 88 aa, Homo sapiens
MRRGRLLEIALGFTVLLASYTSHGADANLEAGNVKETRASRAKRRGGGGHDALKGYKEPVPSFGVGLPSFKIQNNGQDDSPCGRLLGK

SEQ ID NO: 818651 - protein, 173 aa, Homo sapiens
ANSLVIRDCEKEEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAVLPRLLLAVSNRIPAAPCGPEAC

SEQ ID NO: 818652 - protein, 2763 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPQFPFLLQPYASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818653 - protein, 2755 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818654 - protein, 2723 aa, Homo sapiens
MWNNLRERGRELYPGRVVCIIFSIKVTFNVFLKKSIGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818655 - protein, 2757 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMTQPFPTQFAPQKRAVGRGLSHKTFGPRCWQSREQRFFSPRNGSSLNSNRANR

SEQ ID NO: 818656 - protein, 2345 aa, Homo sapiens
MEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818657 - protein, 2500 aa, Homo sapiens
GLLLRASYCRSNRSIGQSDDDEEDNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818658 - protein, 2263 aa, Homo sapiens
MEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818659 - protein, 2313 aa, Homo sapiens
MRSLASWKNNHLQRKLGKGSEGAREGEGKRQRETAGKGERAGEGAGKTKRNGERKKARKRKRTRTAERKGKRTTKDERTEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818660 - protein, 2677 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSVELPLGGIDIFRATSTSP

SEQ ID NO: 818661 - protein, 2263 aa, Homo sapiens; identical to SEQ ID NO: 818658

SEQ ID NO: 818662 - protein, 2024 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKCKLQKRSEGWGMA

SEQ ID NO: 818663 - protein, 1866 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASSRQVFTFNILAPTRSNLLVACLGSTMVLCHGHTVLFCVCSPHEGFVLTISS

SEQ ID NO: 818664 - protein, 2269 aa, Homo sapiens
DRTLKPRSMKERISKLDFIKNVCSAKDTVKRMKSTQKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818665 - protein, 1870 aa, Homo sapiens
ALWATAVNVHNFIDWLMEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818666 - protein, 1193 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQRKQEKEKELERQKEKEKELQKMKEQELEKEQEKQREMEKERKQEKEKELERQK

SEQ ID NO: 818667 - protein, 1122 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKAGEGAGKTKRNGERKKARKRKRTRTAERKGKRTTKEKEQELEKEQEKQREMEKERKQEKEKELERQK

SEQ ID NO: 818668 - protein, 1133 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKRQRETAGKGERAGEGAGKTKRNGERKKARKRKRTRTAERKGKRTTKEKEQELEKEQEKQREMEKERKQEKEKELERQK

SEQ ID NO: 818669 - protein, 654 aa, Homo sapiens
MSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818670 - protein, 1128 aa, Homo sapiens
ANSLVIRDCEKEEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818671 - protein, 1033 aa, Homo sapiens
MTERCSGPYLEVRGPVSTASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818672 - protein, 454 aa, Homo sapiens [sequence omitted]

SEQ ID NO: 818673 - protein, 346 aa, Homo sapiens
RKPSEPDTSFLRSLVLDKNTSPYEPTLSAGRRFSGGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818674 - protein, 284 aa, Homo sapiens
LQEFCTSTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818675 - protein, 170 aa, Homo sapiens
MIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818676 - protein, 316 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASNFGGGGRCEDVPRS

SEQ ID NO: 818677 - protein, 2820 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818678 - protein, 2801 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818679 - protein, 2775 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQKRAVGRGLSHKTFGPRCWQSREQRFFSPRNGSSLNSNRANR

SEQ ID NO: 818680 - protein, 2712 aa, Homo sapiens
SRYEAGWPRDGIQVNVSNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818681 - protein, 2556 aa, Homo sapiens
SQHFGRPRWAIRLRGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818682 - protein, 2487 aa, Homo sapiens
SIAPISCGIMATERLANYTGGIYAEYQDTTYINHVVSVAGWGITDGRSLLQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818683 - protein, 2405 aa, Homo sapiens
MFQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818684 - protein, 2752 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQKRAVGRGLSHKTFGPRCW

SEQ ID NO: 818685 - protein, 2783 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREGAGKTKRNGERKKARKRKRTRTAERKGKRTTKDERTEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818686 - protein, 2500 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSVRSHRDPLDTT

SEQ ID NO: 818687 - protein, 2438 aa, Homo sapiens
INEKRPDGRVTDSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEGAGKTKRNGERKKARKRKRTRTAERKGKRTTKDERTEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQPEKVISKDLVIERPRPDSRPAVKKESTLPPRTYWKEARERDWFPDQGYRGRGRGEYYSRGRSYRGSYGGRGRGGRGHTRDYPQYRDNKPRAEHIPSGPLRQREESETRSESSDFEVVPKRRRQRGSETDTDSEIHESASDKDSLSKGKLPKREERPENKKPVKPHSSFKPDNHVRIDNRLLEKPYVRDDDKAKPGFLPKGEPTRRGRGGTFRRGGRDPGGRPSRPSTLRRPAYRDNQWNPRQSEVPKPEDGEPPRRHEQFIPIAADKRPPKFERKFDPARERPRRQRPTRPPRQDKPPRFRRLREREAASKSNEVVAVPTNGTVNNVAQEPVNTLGDISGNKTPDLSNQNSSDQANEEWETASESSDFNERRERDEKKNADLNAQTVVKVGENVLPPKREIAKRSFSSQRPVDRQNRRGNNGPPKSGRNFSGPRNERRSGPPSKSGKRGPFDDQPAGTTGVDLINGSSAHHQEGVPNGTGQKNSKDCTGKKREDPKPGPKKPKEKVDALSQFDLNNYASVVIIDDHPEVTVIEDPQSNLNDDGFTEVVSKKQQKRLQDEERRKKEEQVIQVWNKKNANEKGRSQTSKLPPRFAKKQATGIQQAQSSASVPPLASAPLPPSTSASVPASTSAPLPATLTPVPASTSAPVPASTLAPVLASTSAPVPASPLAPVSASASVSASVPASTSAAAITSSSAPASAPAPTPILASVSTPASVTILASASIPILASALASTSAPTPAPAASSPAAPVITAPTIPASAPTASVPLAPASASAPAPAPTPVSAPNPAPPAPAQTQAQTHKPVQNPLQTTSQSSKQPPPSIRLPSAQTPNGTDYVASGKSIQTPQSHGTLTAELWDNKVAPPAVLNDISKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818688 - protein, 2263 aa, Homo sapiens; identical to SEQ ID NO: 818658

SEQ ID NO: 818689 - protein, 1212 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEGEKAEKVTEKVVVKPEKTEKKDLPPPPPPPQPPAPIQPQSVPPPIQPEAEKFPSTETATLAQKPSQDTEKPLEPVSTVQVEPAVKTVNQQTMAAPVVKEEKQTPEEIREREREKEREREKVLEKEQAQEREGDASESELKQQEKEKELEKEQEKQREMEKERKQEKEKELERQK

SEQ ID NO: 818690 - protein, 1065 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKELEKEQEKQREMEKERKQEKEKELERQK

SEQ ID NO: 818691 - protein, 1046 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGSKASENNENKKETDEVSNTKSSSQIPAQPSVAKVPYGKGPSFNQERGTSSHLPPPPKLLAQQHPPPDRQAVPGRPGPFPSKQQVADEDEIWKQRRRQQSEISAAVERARRTATEGEERRMEEQRKAACAEKLKRLDEKLGILEKQPSPEEIREREREKEREREKELEKEQEQEREKEREKDRERQQEKEKELEKEQEKQREMEKERKQEKEKELERQKEKEKELQKMKEQEKECELEKEREKLEEKIEPREPNLEPMVEKQESENSCNKEEEPVFTRQDSNRSEKEATPVVHETEPESGSQPRPAVLSGYFKQFQKSLPPRFQRQQEQMKQQQWQQQQQQGVLPQTVPSQPSSSTVPPPPHRPLYQPMQPHPQHLASMGFDPRWLMMQSYMDPRMMSGRPAMDIPPIHPGMIPPKPLMRRDQMEGSPNSSESFEHIARSARDHAISLSEPRMLWGSDPYPHAEPQQATTPKATEEPEDVRSEAALDQEQITAAYSVEHNQLEAHPKADFIRESSEAQVQKFLSRSVEDVRPHHTDANNQSACFEAPDQKTLSTPQEERISAVESQPSRKRSVSHGSNHTQKPDEQRSEPSAGIPKVTSRCIDSKEPIERPEEKPKKEGFIRSSEGPKPEKVYKSKSETRWGPRPSSNRREEVNDRPVRRSGPIKKPVLRDMKEEREQRKEKEESKKKKKN

SEQ ID NO: 818692 - protein, 654 aa, Homo sapiens; identical to SEQ ID NO: 818669

SEQ ID NO: 818693 - protein, 873 aa, Homo sapiens
MDQPLSVDEEGLVLLEQKLSEPKTQINSQLRPMMSELEERARQQRGHLHLLETSIDGILADVKKLGPISPPQPPSVSAWNKPLTSFGSAPSSEGAKNGQESGLEIGTDTIQFGAPASNGNENEVVPVLSEKSADKIPEPKEQRQKQPRAGPIKAQKLPDLSPVENKEHKPGPIGKERSLKNRKVKDAQQVEPEGQEKPSPATVRSTDPVTTKETKAVSEMSTEIGTMISVSSAEYGTNAKESVTDYTTPSSSLPNTVATNNTKMEDTLVNNVPLPNTLPLPKRETIQQSSSLTSVPPTTFSLTFKMESARKAWENSPNVREKGSPVTSTAPPIATGVSSSASGPSTANYNSFSSASMPQIPVASVTPTASLSGAGTYTTSSLSTKSTTTSDPPNICKVKPQQLQTSSLPSASHFSQLSCMPSLIAQQQQNPQVYVSQSAAAQIPAFYMDTSHLFNTQHARLAPPSLAQQQGFQPGLSQPTSVQQIPIPIYAPLQGQHQAQLSLGAGPAVSQAQELFSSSLQPYRSQPAFMQSSLSQPSVVLSGTAIHNFPTVQHQELAKAQSGLAFQQTSNTQPIPILYEHQLGQASGLGGSQLIDTHLLQARANLTQASNLYSGQVQQPGQTNFYNTAQSPSALQQVTVPLPASQLSLPNFGSTGQPLIALPQTLQPPLQHTTPQAQAQSLSRPAQVSQPFRGLIPAGTQHSMIATTGKMSEMELKAFGSGIDIKPGTPPIAGRSTTPTSSPFRATSTSPNSQSSKMNSIVYQKQFQSAPATVRMTQPFPTQFAPQAKQRAEVLQSTQRFFSEQQQSKQIGGGKAQKVDSDSSKPPETLTDPPGVCQEKVEEKPPPAPSIATKPVRTGPIKPQAIKTEETKS

SEQ ID NO: 818694 - protein, 363 aa, Homo sapiens
MSEKSGQSTKAKDGKKYATLSLFNTYKGKSLETQKTTVAARHGLQSLGKVGISRRMPPPANLPSLKAENKGNDPNVNIVPKDGTGWASKQEQHEEEKTPEVPPAQPKPGVAAPPEVAPAPKSWASNKQGGQGDGIQVNSQFQQEFPSLQAAGDQEKKEKETNDDNYGPGPSLRPPNVACWRDGGKAAGSPSSSDQDEKLPGQDESTAGTSEQNDILKVVEKRIACGPPQAKLNGQQAALASQYRAMMPPYMFQQYPRMTYPPLHGPMRFPPSLSETNKGLRGRGPPPSWASEPERPSILSASELKELDKFDNLDAEADEGWAGAQMEVDYTEQLNFSDDDEQGSNSPKENNSEDQGFKTENKT

SEQ ID NO: 818695 - protein, 233 aa, Homo sapiens [sequence omitted]

SEQ ID NO: 818696 - protein, 452 aa, Homo sapiens
SYSNNKSELWVSLIEKAYMKVMGGYDFPGSNSNIDLHALTGWIPERIAMHSDSQTFSKDNSFRMLYQRFHKGDVLITASTGMMTEAEGEKWGLVPTHAYAVLDIREFKGLRFIQLKNPWSHLRWKGRYSENDVKNWTPELQKYLNFDPRTAQKIDNGIFWISWDDLCQYYDVIYLSWNPGLFKESTCIHSTWDAKQGPVKDAYSLANNPQYKLEVQCPQGGAAVWVLLSRHITDKDDFANNREFITMVVYKTDGKKVYYPADPPPYIDGIRINSPHYLTKIKLTTPGTHTFTLVVSQYEKQNTIHYTVRVYSACSFTFSKIPSPYTLSKRINGKWSGQSAGGCGNFQETHKNNPIYQFHIEKTGPLLIELRGPRQYSVGFEVVTVSTLGDPGPHGFLRKSSGDYRCGFCYLELENIPSGIFNIIPSTFLPKQEGPFFLDFNSIIPIKITQLQ

SEQ ID NO: 818697 - protein, 282 aa, Homo sapiens
SYSNNKSELWVSLIEKAYMKVMGGYDFPGSNSNIDLHALTGWIPERIAMHSDSQTFSKDNSFRMLYQRFHKGDVLITASTGMMTEAEGEKWGLVPTHAYAVLDIREFKGLRFIQLKNPWSHLRWKGRYSENDVKNWTPELQKYLNFDPRTAQKIDNGIFWISWDDLCQYYDVIYLSWNPGLFKESTCIHSTWDAKQGPVKDAYSLANNPQYKLEVQCPQGGAAVWVLLSRHITDKDDFANNREFITMVVYKTDGKKVYYPGIFSMQLYFFKDSFTIHLIKTD

SEQ ID NO: 818698 - protein, 340 aa, Homo sapiens
SYSNNKSELWVSLIEKAYMKVMGGYDFPGSNSNIDLHALTGWIPERIAMHSDSQTFSKDNSFRMLYQRFHKGDVLITASTGMMTEAEGEKWGLVPTHAYAVLDIREFKGLRFIQLKNPWSHLRWKGRYSENDVKNWTPELQKYLNFDPRTAQKIDNGIFWISWDDLCQYYDVIYLSWNPGLFKEINMYSQDDFANNREFITMVVYKTDGKKVYYPADPPPYIDGIRINSPHYLTKIKLTTPGTHTFTLVVSQYEKQNTIHYTVRVYSACSFTFSKIPSPYTLSKRINGKWSGQSAGGCGNFQETHKNNPIYQFHIEKTGPLLIELRGPRRSWSPWLSEEI

SEQ ID NO: 818699 - protein, 452 aa, Homo sapiens; identical to SEQ ID NO: 818696

SEQ ID NO: 818700 - protein, 474 aa, Homo sapiens
SYSNNKSELWVSLIEKAYMKVMGGYDFPGSNSNIDLHALTGWIPERIAMHSDSQTFSKDNSFRMLYQRFHKGDVLITASTGMMTEAEGEKWGLVPTHAYAVLDIREFKGLRFIQLKNPWSHLRWKGRYSENDVKNWTPELQKYLNFDPRTAQKIDNGIFWISWDDLCQYYDVIYLSWNPGLFKESTCIHSTWDAKQGPVKDAYSLANNPQYKLEVQCPQGGAAVWVLLSRHITDKDDFANNREFITMVVYKTDGKKVYYPADPPPYIDGIRINSPHYLTKIKLTTPGTHTFTLVVSQYEKQNTIHYTVRVYSACSFTFSKIPSPYTLSKRINGKWSGQSAGGCGNFQETHKNNPIYQFHIEKTGPLLIELRGPRQYSVGFEVVTVSTLGDPGPHGFLRKSSGDYRCGFCYLELENIPSGIFNIIPSTFLPKQEGPFFLDFNSIIAHRGLVVITTSLPVRFAANALAWYTLFPGK

SEQ ID NO: 818701 - protein, 190 aa, Homo sapiens
SYSNNKSELWVSLIEKAYMKVMGGYDFPGSNSNIDLHALTGWIPERIAMHSDSQTFSKDNSFRMLYQRFHKGDVLITASTGMMTEAEGEKWGLVPTHAYAVLDIREFKGLRFIQLKNPWSHLRWKGRYSENDVKNWTPELQKYLNFDPRTAQKIDNGIFWISWDDLCQYYDVIYLSWNPGLFKESTCIHR

SEQ ID NO: 818702 - protein, 1030 aa, Homo sapiens
TSLRKRCCPLAISRPGGRDWNSGESFLFCLRVSLHLAISVLQRAGKALRETAYPPPAAGSALQLCAPENCQRSWVLARRDGPIRRSLALCSFRPLTRRRCGSDGGVGGGRGCRGLGRLGWQLRLVAMEWGSESAAVRRHRVGVERREGAAAAPPPEREARAQEPLVDGCSGGGRTRKRSPGGSGGASRGAGTGLSEVRAALGLALYLIALRTLVQLSLQQLVLRGAAGHRGEFDALQARDYLEHITSIGPRTTGSPENEILTVHYLLEQIKLIEVQSNSLHKISVDVQRPTGSFSIDFLGGFTSYYDNITNVVVKLEPRDGAQHAVLANCHFDSVANSPGASDDAVSCSVMLEVLRVLSTSSEALHHAVIFLFNGAEENVLQASHGFITQHPWASLIRAFINLEAAGVGGKELVFQTGPENPWLVQAYVSAAKHPFASVVAQEVFQSGIIPSDTDFRIYRDFGNIPGIDLAFIENGYIYHTKYDTADRILTDSIQRAGDNILAVLKHLATSDMLAAASKYRHGNMVFFDVLGLFVIAYPSRIGSIINYMVVMGVVLYLGKKFLQPKHKTGNYKKDFLCGLGITLISWFTSLVTVLIIAVFISLIGQSLSWYNHFYVSVCLYGTATVAKIILIHTLAKRFYYMNASAQYLGEVFFDISLFVHCCFLVTLTYQGLCSAFISAVWVAFPLLTKLCVHKDFKQHGAQGKFIAFYLLGMFIPYLYALYLIWAVFEMFTPILGRSGSEIPPDVVLASILAGCTMILSSYFINFIYLAKSTKKTMLTLTLVCAITFLLVCSGTFFPYSSNPANPKPKRVFLQHMTRTFHDLEGNAVKRDSGIWINGFDYTGISHITPHIPEINDSIRAHCEENAPLCGFPWYLPVHFLIRKNWYLPAPEVSPRNPPHFRLISKEQTPWDSIKLTFEATGPSHMSFYVRAHKGSTLSQWSLGNGTPVTSKGGDYFVFYSHGLQASAWQFWIEVQVSEEHPEGMVTVAIAAHYLSGEDKRSPQLDALKEKFPDWTFPSAWVCTYDLFVF

SEQ ID NO: 818703 - protein, 1109 aa, Homo sapiens
TSLRKRCCPLAISRPGGRDWNSGESFLFCLRVSLHLAISVLQRAGKALRETAYPPPAAGSALQLCAPENCQRSWVLARRDGPIRRSLALCSFRPLTRRRCGSDGGVGGGRGCRGLGRLGWQLRLVAMEWGSESAAVRRHRVGVERREGAAAAPPPEREARAQEPLVDGCSGGGRTRKRSPGGSGGASRGAGTGLSEVRAALGLALYLIALRTLVQLSLQQLVLRGAAGHRGEFDALQARYRPLPPGTARASVCGSCAGSGAPHLCAPAPAGPLGLADPSQAARGVEVTLLVLLLGSELPGLGACLSPVKLVVQIGVARDYLEHITSIGPRTTGSPENEILTVHYLLEQIKLIEVQSNSLHKISVDVQRPTGSFSIDFLGGFTSYYDNITNVVVKLEPRDGAQHAVLANCHFDSVANSPGASDDAVSCSVMLEVLRVLSTSSEALHHAVIFLFNGAEENVLQASHGFITQHPWASLIRAFINLEAAGVGGKELVFQTGPENPWLVQAYVSAAKHPFASVVAQEVFQSGIIPSDTDFRIYRDFGNIPGIDLAFIENGYIYHTKYDTADRILTDSIQRAGDNILAVLKHLATSDMLAAASKYRHGNMVFFDVLGLFVIAYPSRIGSIINYMVVMGVVLYLGKKFLQPKHKTGNYKKDFLCGLGITLISWFTSLVTVLIIAVFISLIGQSLSWYNHFYVSVCLYGTATVAKIILIHTLAKRFYYMNASAQYLGEVFFDISLFVHCCFLVTLTYQGLCSAFISAVWVAFPLLTKLCVHKDFKQHGAQGKFIAFYLLGMFIPYLYALYLIWAVFEMFTPILGRSGSEIPPDVVLASILAGCTMILSSYFINFIYLAKSTKKTMLTLTLVCAITFLLVCSGTFFPYSSNPANPKPKRVFLQHMTRTFHDLEGNAVKRDSGIWINGFDYTGISHITPHIPEINDSIRAHCEENAPLCGFPWYLPVHFLIRKNWYLPAPEVSPRNPPHFRLISKEQTPWDSIKLTFEATGPSHMSFYVRAHKGSTLSQWSLGNGTPVTSKGGDYFVFYSHGLQASAWQFWIEVQVSEEHPEGMVTVAIAAHYLSGEDKRSPQLDALKEKFPDWTFPSAWVCTYDLFVF

SEQ ID NO: 818704 - protein, 1030 aa, Homo sapiens; identical to SEQ ID NO: 818702

SEQ ID NO: 818705 - protein, 1030 aa, Homo sapiens; identical to SEQ ID NO: 818702

SEQ ID NO: 818706 - protein, 197 aa, Homo sapiens
SQQRRRKQWRPQLGLGLRAASEGGEGSHWIQSLPSKQPRLGAQCLCPSSTSALAERSRAVGGGGMCSEKRQKNDETDDELSLDDLIDRERNRLGTNATKITLESVLARIQGTRMESTNVSDREVIESRTELVNDDDEESDDTNYTQEHAVDESVNQREEMNRVNADRRDADETLMTVTSLQSSHILQIKMKRDKSSY

SEQ ID NO: 818707 - protein, 522 aa, Homo sapiens
MSLLNCENSCGSSQSESDCCVAMASSCSAVTKDDSVGGTASTGNLSSSFMEEIQGYDVEFDPPLESKYECPICLMALREAVQTPCGHRFCKACIIKSIRDAGHKCPVDNEILLENQLFPDNFAKREILSLMVKCPNEGCLHKMELRHLEDHQAHCEFALMDCPQCQRPFQKFHINIHILKDCPRRQVSCDNCAASMAFEDKEIHDQNCPLANVICEYCNTILIREQMPNHYDLDCPTAPIPCTFSTFGCHEKMQRNHLARHLQENTQSHMRMLAQAVHSLSVIPDSGYISEVRNFQETIHQLEGRLVRQDHQIRELTAKMETQSMYVSELKRTIRTLEDKVAEIEAQQCNGIYIWKIGNFGMHLKCQEEEKPVVIHSPGFYTGKPGYKLCMRLHLQLPTAQRCANYISLFVHTMQGEYDSHLPWPFQGTIRLTILDQSEAPVRQNHEEIMDAKPELLAFQRPTIPRNPKGFGYVTFMHLEALRQRTFIKDDTLLVRCEVSTRFDMGSLRREGFQPRSTDAGV

SEQ ID NO: 818708 - protein, 522 aa, Homo sapiens; identical to SEQ ID NO: 818707

SEQ ID NO: 818709 - protein, 522 aa, Homo sapiens; identical to SEQ ID NO: 818707

SEQ ID NO: 818710 - protein, 380 aa, Homo sapiens
MELRHLEDHQAHCEFALMDCPQCQRPFQKFHINIHILKDCPRRQVSCDNCAASMAFEDKEIHDQNCPLANVICEYCNTILIREQMPNHYDLDCPTAPIPCTFSTFGCHEKMQRNHLARHLQENTQSHMRMLAQAVHSLSVIPDSGYISEVRNFQETIHQLEGRLVRQDHQIRELTAKMETQSMYVSELKRTIRTLEDKVAEIEAQQCNGIYIWKIGNFGMHLKCQEEEKPVVIHSPGFYTGKPGYKLCMRLHLQLPTAQRCANYISLFVHTMQGEYDSHLPWPFQGTIRLTILDQSEAPVRQNHEEIMDAKPELLAFQRPTIPRNPKGFGYVTFMHLEALRQRTFIKDDTLLVRCEVSTRFDMGSLRREGFQPRSTDAGV

SEQ ID NO: 818711 - protein, 270 aa, Homo sapiens [sequence omitted]

SEQ ID NO: 818712 - protein, 283 aa, Homo sapiens
MSLLNCENSCGSSQSESDCCVAMASSCSAVTKDDSVGGTASTGNLSSSFMEEIQGYDVEFDPPLESKYECPICLMALREAVQTPCGHRFCKACIIKSIRDAGHKCPVDNEILLENQLFPDNFAKREILSLMVKCPNEGCLHKMELRHLEDHQAHCEFALMDCPQCQRPFQKFHINIHILKDCPRRQVSCDNCAASMAFEDKEIHDQNCPLANVICEYCNTILIREQMPNHYDLDCPTAPIPCTFSTFGCHEKMQRKSTLEGNYKENNQVTQCSIVWPQDDTNI

SEQ ID NO: 818713 - protein, 851 aa, Homo sapiens
RRGWAGAPGGRCRRRRHSAAMERPWGAADGLSRWPHGLGLLLLLQLLPPSTLSQDRLDAPPPPAAPLPRWSGPIGVSWGLRAAAAGGAFPRGGRWRRSAPGEDEECGRVRDFVAKLANNTHQHVFDDLRGSVSLSWVGDSTGVILVLTTFHVPLVIMTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCKADLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDRHLYTTTGGETDFTNVTSLRGVYITSVLSEDNSIQTMITFDQGGRWTHLRKPENSECDATAKNKNECSLHIHASYSISQKLNVPMAPLSEPNAVGIVIAHGSVGDAISVMVPDVYISDDGGYSWTKMLEGPHYYTILDSGGIIVAIEHSSRPINVIKFSTDEGQCWQTYTFTRDPIYFTGLASEPGARSMNISIWGFTESFLTSQWVSYTIDFKDILERNCEEKDYTIWLAHSTDPEDYEDGCILGYKEQFLRLRKSSVCQNGRDYVVTKQPSICLCSLEDFLCDFGYYRPENDSKCVEQPELKGHDLEFCLYGREEHLTTNGYRKIPGDKCQGGVNPVREVKDLKKKCTSNFLSPEKQNSKSNSVPIILAIVGLMLVTVVAGVLIVKKYVCGGRFLVHRYSVLQQHAEANGVDGVDALDTASHTNKSGYHDDSDEDLLE

SEQ ID NO: 818714 - protein, 851 aa, Homo sapiens; identical to SEQ ID NO: 818713

SEQ ID NO: 818715 - protein, 695 aa, Homo sapiens
MTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCKADLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDRHLYTTTGGETDFTNVTSLRGVYITSVLSEDNSIQTMITFDQGGRWTHLRKPENSECDATAKNKNECSLHIHASYSISQKLNVPMAPLSEPNAVGIVIAHGSVGDAISVMVPDVYISDDGGYSWTKMLEGPHYYTILDSGGIIVAIEHSSRPINVIKFSTDEGQCWQTYTFTRDPIYFTGLASEPGARSMNISIWGFTESFLTSQWVSYTIDFKDILERNCEEKDYTIWLAHSTDPEDYEDGCILGYKEQFLRLRKSSVCQNGRDYVVTKQPSICLCSLEDFLCDFGYYRPENDSKCVEQPELKGHDLEFCLYGREEHLTTNGYRKIPGDKCQGGVNPVREVKDLKKKCTSNFLSPEKQNSKSNSVPIILAIVGLMLVTVVAGVLIVKKYVCGGRFLVHRYSVLQQHAEANGVDGVDALDTASHTNKSGYHDDSDEDLLE

SEQ ID NO: 818716 - protein, 611 aa, Homo sapiens [sequence omitted]

SEQ ID NO: 818717 - protein, 262 aa, Homo sapiens
MKEEVESDIPTFPLLVLPIAWQLPPVGGFCAVYFPEQCVSPLGEEKDYTIWLAHSTDPEDYEDGCILGYKEQFLRLRKSSVCQNGRDYVVTKQPSICLCSLEDFLCDFGYYRPENDSKCVEQPELKGHDLEFCLYGREEHLTTNGYRKIPGDKCQGGVNPVREVKDLKKKCTSNFLSPEKQNSKSNSVPIILAIVGLMLVTVVAGVLIVKKYVCGGRFLVHRYSVLQQHAEANGVDGVDALDTASHTNKSGYHDDSDEDLLE

SEQ ID NO: 818718 - protein, 69 aa, Homo sapiens
TGTNAWATSAKLFPQNHPPQKAPLRDSLTRLKSGVGVKVFFVYFNLGFVELLVSDRLKPFITLWEVFDP

SEQ ID NO: 818719 - protein, 851 aa, Homo sapiens; identical to SEQ ID NO: 818713

SEQ ID NO: 818720 - protein, 851 aa, Homo sapiens; identical to SEQ ID NO: 818713

SEQ ID NO: 818721 - protein, 851 aa, Homo sapiens; identical to SEQ ID NO: 818713

SEQ ID NO: 818722 - protein, 312 aa, Homo sapiens
RRGWAGAPGGRCRRRRHSAAMERPWGAADGLSRWPHGLGLLLLLQLLPPSTLSQDRLDAPPPPAAPLPRWSGPIGVSWGLRAAAAGGAFPRGGRWRRSAPGEDEECGRVRDFVAKLANNTHQHVFDDLRGSVSLSWVGDSTGVILVLTTFHVPLVIMTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKCPCACCSALSLVPFLSMWSFPRLWDSCLPTKV

SEQ ID NO: 818723 - protein, 466 aa, Homo sapiens
RRGWAGAPGGRCRRRRHSAAMERPWGAADGLSRWPHGLGLLLLLQLLPPSTLSQDRLDAPPPPAAPLPRWSGPIGVSWGLRAAAAGGAFPRGGRWRRSAPGEDEECGRVRDFVAKLANNTHQHVFDDLRGSVSLSWVGDSTGVILVLTTFHVPLVIMTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCKADLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDRHLYTTTGGETDFTNVTSLRGVYITSVLSEDNSIQTMITCDEGGRHEILESHLTI

SEQ ID NO: 818724 - protein, 167 aa, Homo sapiens
RRGWAGAPGGRCRRRRHSAAMERPWGAADGLSRWPHGLGLLLLLQLLPPSTLSQDRLDAPPPPAAPLPRWSGPIGVSWGLRAAAAGGAFPRGGRWRRSAPGEDEECGRVRDFVAKLANNTHQHVFDDLRGSVSLSWVGDSTGVILVLTTFHVPLVIMTFGQSKLYRR

SEQ ID NO: 818725 - protein, 860 aa, Homo sapiens
RRGWAGAPGGRCRRRRHSAAMERPWGAADGLSRWPHGLGLLLLLQLLPPSTLSQDRLDAPPPPAAPLPRWSGPIGVSWGLRAAAAGGAFPRGGRWRRSAPGEDEECGRVRDFVAKLANNTHQHVFDDLRGSVSLSWVGDSTGVILVLTTFHVPLVIMTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCKADLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDRHLYTTTGGETDFTNVTSLRGVYITSVLSEDNSIQTMITFDQGGRWTHLRKPENSECDATAKNKNECSLHIHASYSISQKLNVPMAPLSEPNAVGIVIAHGSVGDAISVMVPDVYISDDGGYSWTKMLEGPHYYTILDSGGIIVAIEHSSRPINVIKFSTDEGQCWQTYTFTRDPIYFTGLASEPGARSMNISIWGFTESFLTSQWVSYTIDFKDILERNCEEKDYTIWLAHSTDPEDYEDGCILGYKEQFLRLRKSSVCQNGRDYVVTKQPSICLCSLEDFLCDFGYYRPENDSKCVEQPELKGHDLEFCLYGREEHLTTNGYRKIPGDKCQGGVNPVREVKDLKKKCTSNFLSPEKQNSKSNSVPIILAIVGLMLVTVVAGVLIVKKYVCGGRTSWNSSSEELDPAWMVEPQYLLHSLWLQLQEINFPLRGTQLCFCCFHQSQKDLH

SEQ ID NO: 818726 - protein, 493 aa, Homo sapiens
MAQLPSVGQEQFYSILAANDDMVFMHVDEPGDTGFGTIFTSDDRGIVYSKSLDRHLYTTTGGETDFTNVTSLRGVYITSVLSEDNSIQTMITFDQGGRWTHLRKPENSECDATAKNKNECSLHIHASYSISQKLNVPMAPLSEPNAVGIVIAHGSVGDAISVMVPDVYISDDGGYSWTKMLEGPHYYTILDSGGIIVAIEHSSRPINVIKFSTDEGQCWQTYTFTRDPIYFTGLASEPGARSMNISIWGFTESFLTSQWVSYTIDFKDILERNCEEKDYTIWLAHSTDPEDYEDGCILGYKEQFLRLRKSSVCQNGRDYVVTKQPSICLCSLEDFLCDFGYYRPENDSKCVEQPELKGHDLEFCLYGREEHLTTNGYRKIPGDKCQGGVNPVREVKDLKKKCTSNFLSPEKQNSKSNSVPIILAIVGLMLVTVVAGVLIVKKYVCGGRFLVHRYSVLQQHAEANGVDGVDALDTASHTNKSGYHDDSDEDLLE

SEQ ID NO: 818727 - protein, 851 aa, Homo sapiens; identical to SEQ ID NO: 818713

SEQ ID NO: 818728 - protein, 570 aa, Homo sapiens
RRGWAGAPGGRCRRRRHSAAMERPWGAADGLSRWPHGLGLLLLLQLLPPSTLSQDRLDAPPPPAAPLPRWSGPIGVSWGLRAAAAGGAFPRGGRWRRSAPGEDEECGRVRDFVAKLANNTHQHVFDDLRGSVSLSWVGDSTGVILVLTTFHVPLVIMTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCKADLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDRHLYTTTGGETDFTNVTSLRGVYITSVLSEDNSIQTMITFDQGGRWTHLRKPENSECDATAKNKNECSLHIHASYSISQKLNVPMAPLSEPNAVGIVIAHGSVGDAISVMVPDVYISDDGGYSWTKMLEGPHYYTILDSGGIIVAIEHSSRPINVIKYA

SEQ ID NO: 818729 - protein, 291 aa, Homo sapiens
RRGWAGAPGGRCRRRRHSAAMERPWGAADGLSRWPHGLGLLLLLQLLPPSTLSQDRLDAPPPPAAPLPRWSGPIGVSWGLRAAAAGGAFPRGGRWRRSAPGEDEECGRVRDFVAKLANNTHQHVFDDLRGSVSLSWVGDSTGVILVLTTFHVPLVIMTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTEPMCLLFSPLSCSLSEHVVLPQAVGQLPSHESVKQY

SEQ ID NO: 818730 - protein, 144 aa, Homo sapiens
RRGWAGAPGGRCRRRRHSAAMERPWGAADGLSRWPHGLGLLLLLQLLPPSTLSQDRLDAPPPPAAPLPRWSGPIGVSWGLRAAAAGGAFPRGGRWRRSAPGEDEECGRVRDFVAKLANNTHQHVFDDLRGSVSLSWVGDSTGVC

SEQ ID NO: 818731 - protein, 217 aa, Homo sapiens
MSSLYYANALFSKYPASSSVFATGAFPEQTSCAFASNPQRPGYGAGSGASFAASMQGLYPGGGGMAGQSAAGVYAAGYGLEPSSFNMHCAPFEQNLSGVCPGDSAKAAGAKEQRDSDLAAESNFRIYPWMRSSGTDRKRGRQTYTRYQTLELEKEFHYNRYLTRRRRIEIAHTLCLTERQIKIWFQNRRMKWKKENKTAGPGTTGQDRAEAEEEEEE

SEQ ID NO: 818732 - protein, 151 aa, Homo sapiens [sequence omitted]

SEQ ID NO: 818733 - protein, 263 aa, Homo sapiens
AEPIIGSARGSVDFPCRRRLPVSAGRGLGQRRLLREKSAPGGRFGGGQVPGAGAASLHADKVCGQRKGPRRVLLPLVNLFPLPFNPPPDVFLFRTGGDVNRLKFINTVKFYCISGPQDLYPGGGAGGQVDSLATSDFPAGHVATRTLASGRGREGAWTGPRPLAPHLPTAAHCRHRRRPGTDRKRGRQTYTRYQTLELEKEFHYNRYLTRRRRIEIAHTLCLTERQIKIWFQNRRMKWKKENKTAGPGTTGQDRAEAEEEEEE

SEQ ID NO: 818734 - protein, 217 aa, Homo sapiens; identical to SEQ ID NO: 818731

SEQ ID NO: 818735 - protein, 217 aa, Homo sapiens; identical to SEQ ID NO: 818731

SEQ ID NO: 818736 - protein, 111 aa, Homo sapiens
CWDYRFEPTAPGRRFLYSLIFLWILCAGTDRKRGRQTYTRYQTLELEKEFHYNRYLTRRRRIEIAHTLCLTERQIKIWFQNRRMKWKKENKTAGPGTTGQDRAEAEEEEEE

SEQ ID NO: 818737 - protein, 200 aa, Homo sapiens
MGNGLSDQTSILSNLPSFQSFHIVILGLDCAGKTTVLYRLQFNEFVNTVPTKGFNTEKIKVTLGNSKTVTFHFWDVGGQEKLRPLWKSYTRCTDGIVFVVDSVDVERMEEAKTELHKITRISENQGVPVLIVANKQDLRNSLSLSEIEKLLAMGELSSSTPWHLQPTCAIIGDGLKEGLEKLHDMIIKRRKMLRQQKKKR

SEQ ID NO: 818738 - protein, 200 aa, Homo sapiens; identical to SEQ ID NO: 818737

SEQ ID NO: 818739 - protein, 200 aa, Homo sapiens; identical to SEQ ID NO: 818737

SEQ ID NO: 818740 - protein, 206 aa, Homo sapiens
MGNGLSDQTSILSNLPSFQSFHIVILGLDCAGKTTVLYRLQFNEFVNTVPTKGFNTEKIKVTLGNSKTVTFHFWDVGGQEKLRPLWKSYTRCTDGIVFVVDSVDVERMEEAKTELHKITRISENQGVPVLIVANKQDLRNSLSLSEIEKLLAMGELSSSTPWHLQPTCAIIGDGLKEGLEKLHDMIIKRRKMLRQQSDFAIEECLR

SEQ ID NO: 818741 - protein, 154 aa, Homo sapiens
MSGFENLNTDFYQTSYSIDDQSQQSYDYGGSGGPYSKQYAGYDYSQQGRFVPPDMMQPQQPYTGQIYQPTQAYTPASPQPFYGNNFEDEPPLLEELGINFDHIWQKTLTVLHPLKVADGSIMNETDLAGPMVFCLAFGATLLLVRFSFQPSGCN

SEQ ID NO: 818742 - protein, 257 aa, Homo sapiens
MSGFENLNTDFYQTSYSIDDQSQQSYDYGGSGGPYSKQYAGYDYSQQGRFVPPDMMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISALAMEGQQLLVAYPCALLYGVFALISVF

SEQ ID NO: 818743 - protein, 257 aa, Homo sapiens; identical to SEQ ID NO: 818742

SEQ ID NO: 818744 - protein, 148 aa, Homo sapiens
MSGFENLNTDFYQTSYSIDDQSQQSYDYGGSGGPYSKQYAGYDYSQQGRFVPPDMMQPQQPYTGQIYQPTQAYTPASPQPFYGNNFEDEPPLLEELGINFDHIWQKTLTVLHPLKVADGSIMNETDLAGPMVFCLAFGATLLLECFVY

SEQ ID NO: 818745 - protein, 400 aa, Homo sapiens
MPLSMRYLFIISVSSVIIFIVFSVFNFGGDPSFQRLNISDPLRLTQVCTSFINGKTRFLWKNKLMIHEKSSCKEYLTQSHYITAPLSKEEADFPLAYIMVIHHHFDTFARLFRAIYMPQNIYCVHVDEKATTEFKDAVEQLLSCFPNAFLASKMEPVVYGGISRLQADLNCIRDLSAFEVSWKYVINTCGQDFPLKTNKEIVQYLKGFKGKNITPGVLPPAHAIGRTKYVHQEHLGKELSYVIRTTALKPPPPHNLTIYFGSAYVALSREFANFVLHDPRAVDLLQWSKDTFSPDEHFWVTLNRIPGVPGSMPNASWTGNLRAIKWSDMEDRHGGCHGHYVHGICIYGNGDLKWLVNSPSLFANKFELNTYPLTVECLELRHRERTLNQSETAIQPSWYF

SEQ ID NO: 818746 - protein, 325 aa, Homo sapiens
MPLSMRYLFIISVSSVIIFIVFSVFNFGGDPSFQRLNISDPLRLTQVCTSFINGKTRFLWKNKLMIHEKSSCKEYLTQSHYITAPLSKEEADFPLAYIMVIHHHFDTFARLFRAIYMPQNIYCVHVDEKATTEFKDAVEQLLSCFPNAFLASKMEPVVYGGISRLQADLNCIRDLSAFEVSWKYVINTCGQDFPLKTNKEIVQYLKGFKGKNITPGVLPPAHAIGRTKYVHQEHLGKELSYVIRTTALKPPPPHNLTIYFGSAYVALSREFANFVLHDPRAVDLLQWSKDTFSPDEHFWVTLNRIPGVDLTLWPRLECRGNIMAH

SEQ ID NO: 818747 - protein, 765 aa, Homo sapiens
MLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 818748 - protein, 782 aa, Homo sapiens
ARTYGLGTRPGCVVCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 818749 - protein, 827 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADSPPVDTAWPHAPTLWLLHLPFPQPGAISCPFRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 818750 - protein, 807 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDERAEETWLCAWQVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 818751 - protein, 760 aa, Homo sapiens
MLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSR

SEQ ID NO: 818752 - protein, 745 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTVSGLPFGVWAHSVGWVRVAWCVPHSHLPTPPRQRKGLSLKSSRRRCLLNG

SEQ ID NO: 818753 - protein, 462 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAGNQLHNA

SEQ ID NO: 818754 - protein, 852 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKAGKFFTMLPQSVLICETRLTMVTPQRLKCGIGTWTVSSRMQVLCKSEPWSSAKFFSIDTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 818755 - protein, 598 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 818756 - protein, 509 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHPIQKACIPVGLLGKDICACAATGTVQLPVLGV

SEQ ID NO: 818757 - protein, 588 aa, Homo sapiens
FTGLSVGPSAARVSRPRLQGPFQAHGASQAMPHPPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 818758 - protein, 573 aa, Homo sapiens
MPGLPLFVNPFYFLPLDVILKFRDKIEKMEKDVYAVLQLEAEEKEMQQSEAQINTAKRLLEKGKEAVVQEPERSWFQTKEERKKEKIAKALQEFDLALRGKKKRKKFMKEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 818759 - protein, 402 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTVKLALCPGCLERLIYNPAGPVTAVLCYAHRKLASGALVQDSGARSGTYPLAGCGRNKSETPGEALRESARIYRHHHKAGTKNPKEGSHTQRSNQGRHRKADKSVRSTHSEKARRVITPENICTDTQERRNKHRVND

SEQ ID NO: 818760 - protein, 450 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTERMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 818761 - protein, 320 aa, Homo sapiens
MPCSVLCWLRLLWSIIRGGCLDEQLFVTVSRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 818762 - protein, 447 aa, Homo sapiens
MPGLPLFVNPFYFLPLDVILKFRDKIEKMEKDVYAVLQLEAEEKEMQQSEAQINTAKRLLEKGKEAVVQEPERSWFQTKEERKKEKIAKALQEFDLALRGKKKRKKFMKEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKSRGKVSV

SEQ ID NO: 818763 - protein, 553 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMWLQSRPQPGSKKGPLHTWWGSYWGQRTFLCPCWQHTWGHRLKLADICGLAVFGSVMNSTKTPAKVPRSPAVAWMHSGQPARRLGHFQVVTSWSTKNKRGTQGSGKHQPPGPWVGWDGNSGMCVKGSPTRKATASDTRHRRPLTQCYVTLGPTPQSARGYTLEMSSLHIERGDLWPISTTVTHSGHLQRRCPTITWDQKAAVHERTPRDETYSWNGGTHNRNGGQNNRPQEGLSHHGQPYKTTSGLSYRGHRQERAAEKAKKIAGHLQTHRRQNKAGGGTMVSNKTTRHEYADPERERERIIERKASYEWDEEPGTPA

SEQ ID NO: 818764 - protein, 191 aa, Homo sapiens
MEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 818765 - protein, 121 aa, Homo sapiens
ARTYGLGTRPGCVVCDNMLADLGLIGTIGEDDEVPVEPESDSGDEEEEGPIVLGRRQKALGKNRSADFNPDFVFTEKEGTYDGSWALADVMSQLKKKRAATTLDEKIEKVPLKPSGSSRYT

SEQ ID NO: 818766 - protein, 176 aa, Homo sapiens
KASETKQGTVKMQHKQQLRRMKRRKIPGKPKKTLQEVRTNPKGKKPGKERKTMGNPAKSPKKEHSVPSDKQVKAKTERAKEEIGAVSSKKAVPGKKEEKTTKTVEQEIRKEKSGKTSSILKDKEPIKGKEEKVPASLKEKEPETKKDEKMSKAGKEVKPKLHNTRKQQEEKPEPPN

SEQ ID NO: 818767 - protein, 110 aa, Homo sapiens
KASETKQGTVKMQHKQQLRRMKRRKIPGKPKKTLQEVRTNPKGKKPGKERKTMGNPAKSPKKEHSVPSDKQVKAKTERAKEEIGAVSSKKAVPGKKEEKTTKTVEQGKKK

SEQ ID NO: 818768 - protein, 151 aa, Homo sapiens
MPRERSLGGPPDLLCAQKTCPSSAPRGGPRRTSGEATGTLEGAVDPPFQPHARSLGGKALNTAGHSTALSPKFSLTPCAPATTGSDNMTRGGAGVQVTVPEGASGKYLGGSSPAQALSPYPGHQIFHQGRSKSLSASTALSLAAILSPLFL

SEQ ID NO: 818769 - protein, 74 aa, Homo sapiens
ISSTHAVGDNMTRGGAGVQVTVPEGASGKYLGGSSPAQALSPYPGHQIFHQGRSKSLSASTALSLAAILSPLFL

SEQ ID NO: 818770 - protein, 319 aa, Homo sapiens
STLVEAREVGDAEVPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINTVPEYQGPGLSDGTSKGHLVGRMGSPGQWNGNRAADGNRRRTGGRGGRQAQEEAGTQSNGKGAWAHTRGNWAGEDNVNHKKTQDRQQEK

SEQ ID NO: 818771 - protein, 159 aa, Homo sapiens
LSKNIRGQALRRGEGRARVEGECVSSPGPSSAPRGGPRRTSGEATGTLEGAVDPPFQPHARSLGGKALNTAGHSTALSPKFSLTPCAPATTGSDNMTRGGAGVQVTVPEGASGKYLGGSSPAQALSPYPGHQIFHQGRSKSLSASTALSLAAILSPLFL

SEQ ID NO: 818772 - protein, 911 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818773 - protein, 1210 aa, Homo sapiens
MELGLGHSSELTEDSGFGSEKKSLAGKMGIRNRESMVDVKVGDFWSQDMCEPTWVWYGAGGKSILKSNPIFPSHVPLSACSMAQLFLPLLAALVLAQAPAALADVLEGDSSGKQPHLGSPSLSCSALTNCFQAYGPQEERELEGCGEASRLEHLEIRAELWASGGLEKSWGRTREGHWVQGFGPLRWRIGDPEARRWERGGTGRNPEGGPKGSRLGNWAGGLRGRGWRTLGCGLGILERKWKTLRAGQGILGAELTGRLWGMGLETVGVVLEDLEVGLQDPGPWPLAPGPRGAGESWGRKEGSWSGAWRPPGGTLRVDSVKFQPAPPFTEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818774 - protein, 1226 aa, Homo sapiens
MELGLGHSSELTEDSGFGSEKKSLAGKMGIRNRESMVDVKVGDFWSQDMCEPTWVWYGAGGKSILKSNPIFPSHVPLSACSMAQLFLPLLAALVLAQAPAALADVLEGDSSGKQPHLGSPSLSCSALTNCFQAYGPQEERELEGCGEASRLEHLEIRAELWASGGLEKSWGRTREGHWVQGFGPLRWRIGDPEARRWERGGTGRNPEGGPKGSRLGNWAGGLRGRGWRTLGCGLGILERKWKTLRAGQGILGAELTGRLWGMGLETVGVVLEDLEVGLQDPGPWPLAPGPRGAGESWGRKEGSWSGAWRPPGGTLRVDSVKFQPAPPFTEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGGGHSTHNQLKSLMLQRVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818775 - protein, 911 aa, Homo sapiens; identical to SEQ ID NO: 818772

SEQ ID NO: 818776 - protein, 911 aa, Homo sapiens; identical to SEQ ID NO: 818772

SEQ ID NO: 818777 - protein, 911 aa, Homo sapiens; identical to SEQ ID NO: 818772

SEQ ID NO: 818778 - protein, 911 aa, Homo sapiens; identical to SEQ ID NO: 818772

SEQ ID NO: 818779 - protein, 949 aa, Homo sapiens
MGLETVGVVLEDLEVGLQDPGPWPLAPGPRGAGESWGRKEGSWSGAWRPPGGTLRVDSVKFQPAPPFTEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818780 - protein, 949 aa, Homo sapiens; identical to SEQ ID NO: 818779

SEQ ID NO: 818781 - protein, 1243 aa, Homo sapiens
MELGLGHSSELTEDSGFGSEKKSLAGKMGIRNRESMVDVKVGDFWSQDMCEPTWVWYGAGGKSILKSNPIFPSHVPLSACSMAQLFLPLLAALVLAQAPAALADVLEGDSSGKQPHLGSPSLSCSALTNCFQAYGPQEERELEGCGEASRLEHLEIRAELWASGGLEKSWGRTREGHWVQGFGPLRWRIGDPEARRWERGGTGRNPEGGPKGSRLGNWAGGLRGRGWRTLGCGLGILERKWKTLRAGQGILGAELTGRLWGMGLETVGVVLEDLEVGLQDPGPWPLAPGPRGAGESWGRKEGSWSGAWRPPGGTLRVDSVKFQPAPPFTEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQVLCHCDDSLYSIRGWVGGWVGGLRDGRRLGRVSEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818782 - protein, 763 aa, Homo sapiens
DIVDRAVGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818783 - protein, 1121 aa, Homo sapiens
MELGLGHSSELTEDSGFGSEKKSLAGKMGIRNRESMVDVKVGDFWSQDMCEPTWVWYGAGGKSILKSNPIFPSHVPLSACSMAQLFLPLLAALVLAQAPAALADVLEGDSSGKQPHLGSPSLSCSALTNCFQAYGPQEERELEGCGEASRLEHLEIRAELWASGGLEKSWGRTREGHWVQGFGPLRWRIGDPEARRWERGGTGRNPEGGPKGSRLGNWAGGLRGRGWRTLGCGLGILERKWKTLRAGQGILGAELTGRLWGMGLETVGVVLEDLEVGLQDPGPWPLAPGPRGAGESWGRKEGSWSGAWRPPGGTLRVDSVKFQPAPPFTEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNPVCAFLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818784 - protein, 1224 aa, Homo sapiens
MELGLGHSSELTEDSGFGSEKKSLAGKMGIRNRESMVDVKVGDFWSQDMCEPTWVWYGAGGKSILKSNPIFPSHVPLSACSMAQLFLPLLAALVLAQAPAALADVLEGDSSGKQPHLGSPSLSCSALTNCFQAYGPQEERELEGCGEASRLEHLEIRAELWASGGLEKSWGRTREGHWVQGFGPLRWRIGDPEARRWERGGTGRNPEGGPKGSRLGNWAGGLRGRGWRTLGCGLGILERKWKTLRAGQGILGAELTGRLWGMGLETVGVVLEDLEVGLQDPGPWPLAPGPRGAGESWGRKEGSWSGAWRPPGGTLRVDSVKFQPAPPFTEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKAPVIDLVNDVQCPYRARPPVTRHTRLS

SEQ ID NO: 818785 - protein, 447 aa, Homo sapiens
YGIVDPRALVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818786 - protein, 439 aa, Homo sapiens
NLEDPKFTEYSSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818787 - protein, 1403 aa, Homo sapiens
MELGLGHSSELTEDSGFGSEKKSLAGKMGIRNRESMVDVKVGDFWSQDMCEPTWVWYGAGGKSILKSNPIFPSHVPLSACSMAQLFLPLLAALVLAQAPAALADVLEGDSSGKQPHLGSPSLSCSALTNCFQAYGPQEERELEGCGEASRLEHLEIRAELWASGGLEKSWGRTREGHWVQGFGPLRWRIGDPEARRWERGGTGRNPEGGPKGSRLGNWAGGLRGRGWRTLGCGLGILERKWKTLRAGQGILGAELTGRLWGMGLETVGVVLEDLEVGLQDPGPWPLAPGPRGAGESWGRKEGSWSGAWRPPGGTLRVDSVKFQPAPPFTEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINSGLGDRAGGAPAICSHSLSLAYTAFLINPCTYSLVFSSVHSLTHSFTPLLILSPFPPYCLGSGLRERRVEVRAVECACVGRAAVQGAASNPSNLPALRPPSASSNSNSNLVESFDSFSKTPLFQPGLILPYSPTPIPLLSIWPLSRGWGRRTRQGRVLDRGEGFPRQSPQTARERGTAAICWRLRSLHAFVSLDRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818788 - protein, 194 aa, Homo sapiens [sequence omitted]

SEQ ID NO: 818789 - protein, 985 aa, Homo sapiens
MELGLGHSSELTEDSGFGSEKKSLAGKMGIRNRESMVDVKVGDFWSQDMCEPTWVWYGAGGKSILKSNPIFPSHVPLSACSMAQLFLPLLAALVLAQAPAALADVLEGDSSGKQPHLGSPSLSCSALTNCFQAYGPQEERELEGCGEASRLEHLEIRAELWASGGLEKSWGRTREGHWVQGFGPLRWRIGDPEARRWERGGTGRNPEGGPKGSRLGNWAGGLRGRGWRTLGCGLGILERKWKTLRAGQGILGAELTGRLWGMGLETVGVVLEDLEVGLQDPGPWPLAPGPRGAGESWGRKEGSWSGAWRPPGGTLRVDSVKFQPAPPFTEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGEC

SEQ ID NO: 818790 - protein, 1067 aa, Homo sapiens
MELGLGHSSELTEDSGFGSEKKSLAGKMGIRNRESMVDVKVGDFWSQDMCEPTWVWYGAGGKSILKSNPIFPSHVPLSACSMAQLFLPLLAALVLAQAPAALADVLEGDSSGKQPHLGSPSLSCSALTNCFQAYGPQEERELEGCGEASRLEHLEIRAELWASGGLEKSWGRTREGHWVQGFGPLRWRIGDPEARRWERGGTGRNPEGGPKGSRLGNWAGGLRGRGWRTLGCGLGILERKWKTLRAGQGILGAELTGRLWGMGLETVGVVLEDLEVGLQDPGPWPLAPGPRGAGESWGRKEGSWSGAWRPPGGTLRVDSVKFQPAPPFTEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEVTVSPAPATMVGHAWRRRKGSAAYVCLAMGGTCAMLASASATPAGTPSRAPATSTFPHEGAGRRQRPSAGCTARIWPASAHPRNRTSSTTGTGSTSGSDSTTGPSKATSCGRMASPCSMRTGTLGSLTATSCLERTAWSWCGMIRDNGVTCPATTTCPTPARWGWCPVGRHRSCPWLKCSAAHGCAMRWTLCFATGAGKDWPSAICR

SEQ ID NO: 818791 - protein, 1121 aa, Homo sapiens
MELGLGHSSELTEDSGFGSEKKSLAGKMGIRNRESMVDVKVGDFWSQDMCEPTWVWYGAGGKSILKSNPIFPSHVPLSACSMAQLFLPLLAALVLAQAPAALADVLEGDSSGKQPHLGSPSLSCSALTNCFQAYGPQEERELEGCGEASRLEHLEIRAELWASGGLEKSWGRTREGHWVQGFGPLRWRIGDPEARRWERGGTGRNPEGGPKGSRLGNWAGGLRGRGWRTLGCGLGILERKWKTLRAGQGILGAELTGRLWGMGLETVGVVLEDLEVGLQDPGPWPLAPGPRGAGESWGRKEGSWSGAWRPPGGTLRVDSVKFQPAPPFTEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASDRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818792 - protein, 153 aa, Homo sapiens
MEVVGVVRCVYTRACLHTHTHTHTERERERERERERPGLNSLGWVYEDCEGDGHPGSDRNDVTRGKFPEQLKKFKTRAEIQTLELKQRGGCCGVKGTDRMTAELSGLELEEVEERVGSGEAVLTCVRSRRPSWKRPGEYGVPGGRDSLEGRRG

SEQ ID NO: 818793 - protein, 671 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGNSAQGSTALSILLLFFPLQLWVT

SEQ ID NO: 818794 - protein, 153 aa, Homo sapiens; identical to SEQ ID NO: 818792

SEQ ID NO: 818795 - protein, 122 aa, Homo sapiens [sequence omitted]

SEQ ID NO: 818796 - protein, 204 aa, Homo sapiens
RTYVDHGVCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818797 - protein, 153 aa, Homo sapiens; identical to SEQ ID NO: 818792

SEQ ID NO: 818798 - protein, 153 aa, Homo sapiens; identical to SEQ ID NO: 818792

SEQ ID NO: 818799 - protein, 154 aa, Homo sapiens
DNGVTCPATTMTTQFSPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818800 - protein, 140 aa, Homo sapiens
VTCDTALNVGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818801 - protein, 116 aa, Homo sapiens
DRWCVMHYTVYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 818802 - protein, 179 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGGRFLLAEKGAPGPRLLPLSSFYF

SEQ ID NO: 818803 - protein, 112 aa, Homo sapiens
TPIPLLSIWPLSRGWGRRTRQGRVLDRGEGFPRQSPQTARERGTAAICWRLRSLHAFVSLDRYREYQWIGLNDRTIEGDFLWSDGVPLVRGPSRTPPSSSLPLSTSVPYHPH

SEQ ID NO: 818804 - protein, 77 aa, Homo sapiens
DGGLDHCSPGWLADGSVRYPIVTPSQRCGGGLPGVKTLFLFPNQTGFPNKHSRFNVYCFRGEPTSLQKLRPISERQS

SEQ ID NO: 818805 - protein, 95 aa, Homo sapiens
DEGTGEACPGFPWETRVEGATSCLITQPSLLHPGELFLGDPPEKLTLEEARAYCQERGAEIATTGQLYAAWDGGLDHCSPGWLADGSVRYPIVTP

SEQ ID NO: 818806 - protein, 458 aa, Homo sapiens
LRECRTAEWLLAKMAVAIAAARVWRLNRGLSQAALLLLRQPGARGLARSHPPRQQQQFSSLDDKPQFPGASAEFIDKLEFIQPNVISGIPIYRVMDRQGQIINPSEDPHLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKVMEAFEQAERKPKPNPNLLFSDVYQEMPAQLRKQQESLARHLQTYGEHYPLDHFDK

SEQ ID NO: 818807 - protein, 458 aa, Homo sapiens; identical to SEQ ID NO: 818806

SEQ ID NO: 818808 - protein, 475 aa, Homo sapiens
LRECRTAEWLLAKMAVAIAAARVWRLNRGLSQAALLLLRQPGARGLARSHPPRQQQQFSSLDDKPQFPGASAEFIDKLEFIQPNVISGIPIYRVMDRQGQIINPSEDPHLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKTCIRRCPPSSASSRSLWPATCRPTGSTTHWITSISETCSAHPHPSSATPRGSPTLRGAGGPDSTPLSSPVSSL

SEQ ID NO: 818809 - protein, 458 aa, Homo sapiens; identical to SEQ ID NO: 818806

SEQ ID NO: 818810 - protein, 150 aa, Homo sapiens
MATSVTWARGARCLSTTAARNATSSLSPLHWPRRSLRRWGRRTQPSGPMPTGSSSVTSARGQPVRGTPMPASTSLPHLSAPSSSSAGTMATPSPRPPLSSIAAMALQHEAPGMASCQSAWMVMMCLPYTTPQRRPDGGLWQRTSPFSSRP

SEQ ID NO: 818811 - protein, 480 aa, Homo sapiens
MAVAIAAARVWRLNRGLSQAALLLLRQPGARGLARSHPPRQQQQFSSLDDKPQFPGASAEFIDKLEFIQPNVISGIPIYRVMDRQGQIINPSEDPHVRGGSPTSRAPHAQAPCLSPLWSQLPHVYLCLHPQLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKVMEAFEQAERKPKPNPNLLFSDVYQEMPAQLRKQQESLARHLQTYGEHYPLDHFDK

SEQ ID NO: 818812 - protein, 476 aa, Homo sapiens
MAVAIAAARVWRLNRGLSQAALLLLRQPGARGLARSHPPRQQQQFSSLDDKPQFPGASAEFIDKLEFIQPNVISGIPIYRVMDRQGQIINPSEDPHLPKEKVLKLYKSMTLLNTMDRILYESQRQGRISFYMTNYGEEGTHVGSAAALDNTDLVFGQYREAEARPHHVAQAGLQLLGSSDPPTSASQSAGITGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKVMEAFEQAERKPKPNPNLLFSDVYQEMPAQLRKQQESLARHLQTYGEHYPLDHFDK

SEQ ID NO: 818813 - protein, 287 aa, Homo sapiens
MVQGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKVMEAFEQAERKPKPNPNLLFSDVYQEMPAQLRKQQESLARHLQTYGEHYPLDHFDK

SEQ ID NO: 818814 - protein, 458 aa, Homo sapiens; identical to SEQ ID NO: 818806

SEQ ID NO: 818815 - protein, 405 aa, Homo sapiens
LRECRTAEWLLAKMAVAIAAARVWRLNRGLSQAALLLLRQPGARGLARSHPPRQQQQFSSLDDKPQFPGASAEFIDKLEFIQPNVISGIPIYRVMDRQGQIINPSEDPHLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKRWI

SEQ ID NO: 818816 - protein, 413 aa, Homo sapiens
HRSQVLIAPVHWTMLAQLPSGPIGESPDMSYWHSIAWPNVISGIPIYRVMDRQGQIINPSEDPHLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKVMEAFEQAERKPKPNPNLLFSDVYQEMPAQLRKQQESLARHLQTYGEHYPLDHFDK

SEQ ID NO: 818817 - protein, 255 aa, Homo sapiens
MPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKVMEAFEQAERKPKPNPNLLFSDVYQEMPAQLRKQQESLARHLQTYGEHYPLDHFDK

SEQ ID NO: 818818 - protein, 170 aa, Homo sapiens
LRECRTAEWLLAKMAVAIAAARVWRLNRGLSQAALLLLRQPGARGLARSHPPRQQQQFSSLDDKPQFPGASAEFIDKLEFIQPNVISGIPIYRVMDRQGQIINPSEDPHLPKEKVLKLYKSMTLLNTMDRILYESQRQSPVVTVPSPRGWVRAHSGLEAHPQLPREVAPL

SEQ ID NO: 818819 - protein, 120 aa, Homo sapiens
MDDSKVVGGKVKKPGKRGRKPAKIDLKAKLERSRQSARECRARKKLRYQYLEELVSSRERAICALREELEMYKQWCMAMDQGKIPSEIKALLTGEEQNKSQQNSSRHTKAGKTDANSNSW

SEQ ID NO: 818820 - protein, 120 aa, Homo sapiens; identical to SEQ ID NO: 818819

SEQ ID NO: 818821 - protein, 102 aa, Homo sapiens
MDDSKVVGGKVKKPGKRGRKPAKIDLKAKLERSRQSARECRARKKLRYQYLEELVSSRERAICALREELEMYKQWCMAMDQGQQNSSRHTKAGKTDANSNSW

SEQ ID NO: 818822 - protein, 74 aa, Homo sapiens
RTAAEGAIPCAALPPTLRSRRLSRASVNTQRLSWRGRRRRRRRREAFGAASRVRSAIPELVPRPRDSGIREANC

SEQ ID NO: 818823 - protein, 120 aa, Homo sapiens; identical to SEQ ID NO: 818819

SEQ ID NO: 818824 - protein, 120 aa, Homo sapiens; identical to SEQ ID NO: 818819

SEQ ID NO: 818825 - protein, 137 aa, Homo sapiens
MTGPPRVDVIVSVISIRAARYGCEKTTEGVRAFYVNVLNEEQRKRLCENIAGHLKDAQIFIQKKAVKNFTEVHPDYGSHIQALLDKYNAEKPKNAIHTFVQSGSHLAAKGEGKSVRPGPCTCAAKLSVHPCNPLITG

SEQ ID NO: 818826 - protein, 550 aa, Homo sapiens
MADSRDPASDQMQHWKEQRAAQKADVLTTGAGNPVGDKLNVITVGPRGPLLVQDVVFTDEMAHFDRERIPERVVHAKGAGAFGYFEVTHDITKYSKAKVFEHIGKKTPIAVRFSTVAGESGSADTVRDPRGFAVKFYTEDGNWDLVGNNTPIFFIRDPILFPSFIHSQKRNPQTHLKDPDMVWDFWSLRPESLHQVSFLFSDRGIPDGHRHMNGYGSHTFKLVNANGEAVYCKFHYKTDQGIKNLSVEDAARLSQEDPDYGIRDLFNAIATGKYPSWTFYIQVMTFNQAETFPFNPFDLTKVWPHKDYPLIPVGKLVLNRNPVNYFAEVEQIAFDPSNMPPGIEASPDKMLQGRLFAYPDTHRHRLGPNYLHIPVNCPYRARVANYQRDGPMCMQDNQGGAPNYYPNSFGAPEQQPSALEHSIQYSGEVRRFNTANDDNVTQVRAFYVNVLNEEQRKRLCENIAGHLKDAQIFIQKKAVKNFTEVHPDYGSHIQALLDKYNAEKPKNAIHTFVQSGSHLAAKGEGKSVRPGPCTCAAKLSVHPCNPLITG

SEQ ID NO: 818827 - protein, 550 aa, Homo sapiens; identical to SEQ ID NO: 818826

SEQ ID NO: 818828 - protein, 550 aa, Homo sapiens; identical to SEQ ID NO: 818826

SEQ ID NO: 818829 - protein, 531 aa, Homo sapiens
MADSRDPASDQMQHWKEQRAAQKADVLTTGAGNPVGDKLNVITVGPRGPLLVQDVVFTDEMAHFDRERIPERVVHAKGAGAFGYFEVTHDITKYSKAKVFEHIGKKTPIAVRFSTVAGESGSADTVRDPRGFAVKFYTEDGNWDLVGNNTPIFFIRDPILSSFIHSRSLRPESLHQVSFLFSDRGIPDGHRHMNGYGSHTFKLVNANGEAVYCKFHYKTDQGIKNLSVEDAARLSQEDPDYGIRDLFNAIATGKYPSWTFYIQVMTFNQAETFPFNPFDLTKVWPHKDYPLIPVGKLVLNRNPVNYFAEVEQIAFDPSNMPPGIEASPDKMLQGRLFAYPDTHRHRLGPNYLHIPVNCPYRARVANYQRDGPMCMQDNQGGAPNYYPNSFGAPEQQPSALEHSIQYSGEVRRFNTANDDNVTQVRAFYVNVLNEEQRKRLCENIAGHLKDAQIFIQKKAVKNFTEVHPDYGSHIQALLDKYNAEKPKNAIHTFVQSGSHLAAKGEGKSVRPGPCTCAAKLSVHPCNPLITG

SEQ ID NO: 818830 - protein, 536 aa, Homo sapiens
MADSRDPASDQMQHWKEQRAAQKADVLTTGAGNPVGDKLNVITVGPRGPLLVQDVVFTDEMAHFDRERIPERVVHAKGAGAFGYFEVTHDITKYSKAKVFEHIGKKTPIAVRFSTVAGESGSADTVRDPRGFAVKFYTEDGNWDLVGNNTPIFFIRDPILFPSFIHSQKRNPQTHLKDPDMVWDFWSLRPESLHQVSFLFSDRGIPDGHRHMNGYGSHTFKLVNANGEAVYCKFHYKTDQGIKNLSVEDAARLSQEDPDYGIRDLFNAIATGKYPSWTFYIQVMTFNQAETFPFNPFDLTKVWPHKDYPLIPVGKLVLNRNPVNYFAEVEQIAFDPSNMPPGIEASPDKMLQGPNYLHIPVNCPYRARVANYQRDGPMCMQDNQGGAPNYYPNSFGAPEQQPSALEHSIQYSGEVRRFNTANDDNVTQVRAFYVNVLNEEQRKRLCENIAGHLKDAQIFIQKKAVKNFTEVHPDYGSHIQALLDKYNAEKPKNAIHTFVQSGSHLAAKGEGKSVRPGPCTCAAKLSVHPCNPLITG

SEQ ID NO: 818831 - protein, 267 aa, Homo sapiens
MTFNQAETFPFNPFDLTKVWPHKDYPLIPVGKLVLNRNPVNYFAEVEQIAFDPSNMPPGIEASPDKMLQGRLFAYPDTHRHRLGPNYLHIPVNCPYRARVANYQRDGPMCMQDNQGGAPNYYPNSFGAPEQQPSALEHSIQYSGEVRRFNTANDDNVTQVRAFYVNVLNEEQRKRLCENIAGHLKDAQIFIQKKAVKNFTEVHPDYGSHIQALLDKYNAEKPKNAIHTFVQSGSHLAAKGEGKSVRPGPCTCAAKLSVHPCNPLITG

SEQ ID NO: 818832 - protein, 531 aa, Homo sapiens
MADSRDPASDQMQHWKEQRAAQKADVLTTGAGNPVGDKLNVITVGPRGPLLVQDVVFTDEMAHFDRERIPERVVHAKGAGAFGYFEVTHDITKYSKAKVFEHIGKKTPIAVRFSTVAGESGSADTVRDPRGFAVKFYTEDGNWDLVGNNTPIFFIRDPILFPSFIHSQKRNPQTHLKDPDMVWDFWSLRPESLHQVSFLFSDRGIPDGHRHMNGYGSHTFKLVNANGEAVYCKFHYKTDQGIKNLSVEDAARLSQEDPDYGIRDLFNAIATGKYPSWTFYIQVMTFNQAETFPFNPFDLTKVWPHKDYPLIPVGKLVLNRNPVNYFAEVEQIAFDPSNMPPGIEASPDKMLQGRLFAYPDTHRHRLGPNYLHIPVNCPYRGAPNYYPNSFGAPEQQPSALEHSIQYSGEVRRFNTANDDNVTQVRAFYVNVLNEEQRKRLCENIAGHLKDAQIFIQKKAVKNFTEVHPDYGSHIQALLDKYNAEKPKNAIHTFVQSGSHLAAKGEGKSVRPGPCTCAAKLSVHPCNPLITG

SEQ ID NO: 818833 - protein, 550 aa, Homo sapiens; identical to SEQ ID NO: 818826

SEQ ID NO: 818834 - protein, 215 aa, Homo sapiens
MLYVTAPSQCLLYLLLQGRLFAYPDTHRHRLGPNYLHIPVNCPYRARVANYQRDGPMCMQDNQGGAPNYYPNSFGAPEQQPSALEHSIQYSGEVRRFNTANDDNVTQVRAFYVNVLNEEQRKRLCENIAGHLKDAQIFIQKKAVKNFTEVHPDYGSHIQALLDKYNAEKPKNAIHTFVQSGSHLAAKGEGKSVRPGPCTCAAKLSVHPCNPLITG

SEQ ID NO: 818835 - protein, 215 aa, Homo sapiens; identical to SEQ ID NO: 818834

SEQ ID NO: 818836 - protein, 215 aa, Homo sapiens; identical to SEQ ID NO: 818834

SEQ ID NO: 818837 - protein, 550 aa, Homo sapiens; identical to SEQ ID NO: 818826

SEQ ID NO: 818838 - protein, 550 aa, Homo sapiens; identical to SEQ ID NO: 818826

SEQ ID NO: 818839 - protein, 176 aa, Homo sapiens
MEKNYRVADDEYCKSIGSYRGSCVRGAPNYYPNSFGAPEQQPSALEHSIQYSGEVRRFNTANDDNVTQVRAFYVNVLNEEQRKRLCENIAGHLKDAQIFIQKKAVKNFTEVHPDYGSHIQALLDKYNAEKPKNAIHTFVQSGSHLAAKGEGKSVRPGPCTCAAKLSVHPCNPLITG

SEQ ID NO: 818840 - protein, 511 aa, Homo sapiens
MADSRDPASDQMQHWKEQRAAQKADVLTTGAGNPVGDKLNVITVGPRGPLLVQDVVFTDEMAHFDRERIPERVVHAKGAGAFGYFEVTHDITKYSKAKVFEHIGKKTPIAVRFSTVAGESGSADTVRDPRGFAVKFYTEDGNWDLVGNNTPIFFIRDPILFPSFIHSQKRNPQTHLKDPDMVWDFWSLRPESLHQVSFLFSDRGIPDGHRHMNGYGSHTFKLVNANGEAVYCKFHYKTDQGIKNLSVEDAARLSQEDPDYGIRDLFNAIATGKYPSWTFYIQVMTFNQAETFPFNPFDLTKVWPHKDYPLIPVGKLVLNRNPVNYFAEVEQIAFDPSNMPPGIEASPDKMLQGRLFAYPDTHRHRLGPNYLHIPVNCPYRARVANYQRDGPMCMQDNQGGAPNYYPNSFGAPEQQPSALEHSIQYSGEVRRFNTANDDNVTQVRAFYVNVLNEEQRKRLCENIAGHLKDAQIFIQKKAVSLCKLKGVLCWLRKTVQLCGRTLKRKCHFCFT

SEQ ID NO: 818841 - protein, 358 aa, Homo sapiens
MADSRDPASDQMQHWKEQRAAQKADVLTTGAGNPVGDKLNVITVGPRGPLLVQDVVFTDEMAHFDRERIPERVVHAKGAGAFGYFEVTHDITKYSKAKVFEHIGKKTPIAVRFSTVAGESGSADTVRDPRGFAVKFYTEDGNWDLVGNNTPIFFIRDPILFPSFIHSQKRNPQTHLKDPDMVWDFWSLRPESLHQVSFLFSDRGIPDGHRHMNGYGSHTFKLVNANGEAVYCKFHYKTDQGIKNLSVEDAARLSQEDPDYGIRDLFNAIATGKYPSWTFYIQVMTFNQAETFPFNPFDLTKVWPHKDYPLIPVGKLVLNRNPVNYFAEVEQIAFDPSNMPPGIEASPDKMLQQVSLVD

SEQ ID NO: 818842 - protein, 175 aa, Homo sapiens
MADSRDPASDQMQHWKEQRAAQKADVLTTGAGNPVGDKLNVITVGPRGPLLVQDVVFTDEMAHFDRERIPERVVHAKGAGAFGYFEVTHDITKYSKAKVFEHIGKKTPIAVRFSTVAGESGSADTVRDPRGFAVKFYTEDGNWDLVGNNTPIFFVQGMPILVSILLFHHSDFLEP

SEQ ID NO: 818843 - protein, 530 aa, Homo sapiens
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEQQNKDEGKKPEVKKVEKKRETSMDSRLQRIHAEIKNSLKIDNLDVNRCIEALDELASLQVTMQQAQKHTEMITTLKKIRRFKVSQVIMEKSTMLYNKFKNMFLVGEGDSVITQVLNKSLAEQRQHEEANKTKDQGKKGPNKKLEKEQTGSKTLNGGSDAQDGNQPQHNGESNEDSKDNHEASTKKKPSSEERETEISLKDSTLDN

SEQ ID NO: 818844 - protein, 333 aa, Homo sapiens
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEHQTTCNLQ

SEQ ID NO: 818845 - protein, 333 aa, Homo sapiens; identical to SEQ ID NO: 818844

SEQ ID NO: 818846 - protein, 153 aa, Homo sapiens
MCILATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEHQTTCNLQ

SEQ ID NO: 818847 - protein, 245 aa, Homo sapiens
MQQETVPVPVPSEKTKQPKECFLIQPKERKENTTKTRKRRKKKITDVLAKSEPKPGLPEDLQKLMKDYYSSRRLVIELEELNLPDSCFLKANDLTHSLSSYLKEICPKWVKLRKNHSEKKSVLMLIICSSAVRALELIRSMTAFRGDGKVIKLFAKHIKVQAQVKLLEKRVVHLGVGTPGRIKELVKQGGLNLSPLKFLVFDWNWRDQKLRRMMDIPEIRKEVFELLEMGVLSLCKSESLKLGLF

SEQ ID NO: 818848 - protein, 279 aa, Homo sapiens
MADDLGDEWWENQPTGAGSSPEASDGEGEGDTEVMQQETVPVPVPSEKTKQPKECFLIQPKERKENTTKTRKRRKKKITDVLAKSEPKPGLPEDLQKLMKDYYSSRRLVIELEELNLPDSCFLKANDLTHSLSSYLKEICPKWVKLRKNHSEKKSVLMLIICSSAVRALELIRSMTAFRGDGKVIKLFAKHIKVQAQVKLLEKRVVHLGVGTPGRIKELVKQGGLNLSPLKFLVFDWNWRDQKLRRMMDIPEIRKEVFELLEMGVLSLCKSESLKLGLF

SEQ ID NO: 818849 - protein, 73 aa, Homo sapiens
FEFGTQSVYTKELVKQGGLNLSPLKFLVFDWNWRDQKLRRMMDIPEIRKEVFELLEMGVLSLCKSESLKLGLF

SEQ ID NO: 818850 - protein, 186 aa, Homo sapiens
MLTSQGSNPPVLDLSRRALLITTATDSCFLKANDLTHSLSSYLKEICPKWVKLRKNHSEKKSVLMLIICSSAVRALELIRSMTAFRGDGKVIKLFAKHIKVQAQVKLLEKRVVHLGVGTPGRIKELVKQGGLNLSPLKFLVFDWNWRDQKLRRMMDIPEIRKEVFELLEMGVLSLCKSESLKLGLF

SEQ ID NO: 818851 - protein, 284 aa, Homo sapiens
KTKKTTNKGGGEGGLAATTLLISTATEASDGEGEGDTEVMQQETVPVPVPSEKTKQPKECFLIQPKERKENTTKTRKRRKKKITDVLAKSEPKPGLPEDLQKLMKDYYSSRRLVIELEELNLPDSCFLKANDLTHSLSSYLKEICPKWVKLRKNHSEKKSVLMLIICSSAVRALELIRSMTAFRGDGKVIKLFAKHIKVQAQVKLLEKRVVHLGVGTPGRIKELVKQGGLNLSPLKFLVFDWNWRDQKLRRMMDIPEIRKEVFELLEMGVLSLCKSESLKLGLF

SEQ ID NO: 818852 - protein, 245 aa, Homo sapiens; identical to SEQ ID NO: 818847

SEQ ID NO: 818853 - protein, 245 aa, Homo sapiens; identical to SEQ ID NO: 818847

SEQ ID NO: 818854 - protein, 400 aa, Homo sapiens
GSSSFDRELEREKERQRLEREAKEREKERRRSRSIDRGLERRRSRSRERHRSRSRSRDRKGDRRDRDREREKENERGRRRDRDYDKERGNEREKERERSRERSKEQRSRGEVEEKKHKEDKDDRRHRDDKRDSKKEKKTSSPEASDGEGEGDTEVMQQETVPVPVPSEKTKQPKECFLIQPKERKENTTKTRKRRKKKITDVLAKSEPKPGLPEDLQKLMKDYYSSRRLVIELEELNLPDSCFLKANDLTHSLSSYLKEICPKWVKLRKNHSEKKSVLMLIICSSAVRALELIRSMTAFRGDGKVIKLFAKHIKVQAQVKLLEKRVVHLGVGTPGRIKELVKQGGLNLSPLKFLVFDWNWRDQKLRRMMDIPEIRKEVFELLEMGVLSLCKSESLKLGLF

SEQ ID NO: 818855 - protein, 245 aa, Homo sapiens; identical to SEQ ID NO: 818847

SEQ ID NO: 818856 - protein, 279 aa, Homo sapiens; identical to SEQ ID NO: 818848

SEQ ID NO: 818857 - protein, 181 aa, Homo sapiens [sequence omitted]

SEQ ID NO: 818858 - protein, 279 aa, Homo sapiens; identical to SEQ ID NO: 818848

SEQ ID NO: 818859 - protein, 279 aa, Homo sapiens; identical to SEQ ID NO: 818848

SEQ ID NO: 818860 - protein, 279 aa, Homo sapiens; identical to SEQ ID NO: 818848

SEQ ID NO: 818861 - protein, 279 aa, Homo sapiens; identical to SEQ ID NO: 818848

SEQ ID NO: 818862 - protein, 167 aa, Homo sapiens
KTKKTTNKGGGEGGLAATTLLISTATVCPKWVKLRKNHSEKKSVLMLIICSSAVRALELIRSMTAFRGDGKVIKLFAKHIKVQAQVKLLEKRVVHLGVGTPGRIKELVKQGGLNLSPLKFLVFDWNWRDQKLRRMMDIPEIRKEVFELLEMGVLSLCKSESLKLGLF

SEQ ID NO: 818863 - protein, 262 aa, Homo sapiens
MADDLGDEWWENQPTGAGSSPEASDGEGEGDTEVMQQETVPVPVPSEKTKQPKECFLIQPKERKENTTKTRKRRKKKITDVLAKSEPKPGLPEDLQKLMKDYYSSRRLVIELEELNLPDSCFLKANDLTHSLSSYLKEICPKWVKLRKNHSEKKSVLMLIICSSAVRALELIRSMTAFRGDGKVIKLFAKHIKVQAQVKLLEKRVVHLGVGTPGRIKELVKQGGLNLSPLKFLVFDWNWRDQKLRRMMDIPEIKKVVWWYSP

SEQ ID NO: 818864 - protein, 128 aa, Homo sapiens
LLLLNSRLLDDHLQLGRPTPGASMTAFRGDGKVIKLFAKHIKVQAQVKLLEKRVVHLGVGTPGRIKELVKQGGLNLSPLKFLVFDWNWRDQKLRRMMDIPEIRKEVFELLEMGVLSLCKSESLKLGLF

SEQ ID NO: 818865 - protein, 215 aa, Homo sapiens
MADDLGDEWWENQPTGAGSSPEASDGEGEGDTEVMQQETVPVPVPSEKTKQPKECFLIQPKERKENTTKTRKRRKKKITDVLAKSEPKPGLPEDLQKLMKDYYSSRRLVIELEELNLPDSCFLKANDLTHSLSSYLKEICPKWVKLRKNHSEKKSVLMLIICSSAVRALELIRSMTAFRGDGKVIKLFAKHIKPGAGKVAGEACGAPGCMNFREN

SEQ ID NO: 818866 - protein, 323 aa, Homo sapiens
IKHKRRRTRGGGRGAICNDSLNLHRYRVSILPYSDGYQNWRQNPPGFGLLRDSIGFLHDAFLGDLQEASDGEGEGDTEVMQQETVPVPVPSEKTKQPKECFLIQPKERKENTTKTRKRRKKKITDVLAKSEPKPGLPEDLQKLMKDYYSSRRLVIELEELNLPDSCFLKANDLTHSLSSYLKEICPKWVKLRKNHSEKKSVLMLIICSSAVRALELIRSMTAFRGDGKVIKLFAKHIKPGAGKVAGKPVVHLGVGTSGRIKELGKQGGLNLSPLKFLVFDWNWRDQKLRRMMDIPEIRKEVFELLEMGVLSLCKSESLKLGLF

SEQ ID NO: 818867 - protein, 173 aa, Homo sapiens
MADDLGDEWWENQPTGAGSSPEASDGEGEGDTEVMQQETVPVPVPSEKTKQPKECFLIQPKERKENTTKTRKRRKKKITDVLAKSEPKPGLPEDLQKLMKDYYSSRRLVIELEELNLPDSCFLKANDLTHSLSSYLKEICPKWVKLRKNHSEKKSVLMLIICSSAVRALELIR

SEQ ID NO: 818868 - protein, 815 aa, Homo sapiens
MAGGHCGSFPAAAAGSGEIVQLNVGGTRFSTSRQTLMWIPDSFFSSLLSGRISTLRDETGAIFIDRDPAAFAPILNFLRTKELDLRGVSINVLRHEAEFYGITPLVRRLLLCEELERSSCGSVLFHGYLPPPGIPSRKINNTVRSADSRNGLNSTEGEARGNGTQPVLSGTGEETVRLGFPVDPRKVLIVAGHHNWIVAAYAHFAVCYRIKESSGWQQVFTSPYLDWTIERVALNAKVVGGPHGDKDKMVAVASESSIILWSVQDGGSGSEIGVFSLGVPVDALFFIGNQLVATSHTGKVGVWNAVTQHWQVQDVVPITSYDTAGSFLLLGCNNGSIYYIDMQKFPLRMKDNDLLVTELYHDPSNDAITALSVYLTPKTSVSGNWIEIAYGTSSGAVRVIVQHPETVGSGPQLFQTFTVHRSPVTKIMLSEKHLVSVCADNNHVRTWTVTRFRGMISTQPGSTPLASFKILSLEETESHGSYSSGNDIGPFGERDDQQVFIQKVVPITNKLFVRLSSTGKRICEIQAVDCTTISSFTVRECEGSSRMGSRPRRYLFTGHTNGSIQMWDLTTAMDMVNKSEDKDVGGPTEEELLKLLDQCDLSTSRCATPNISPATSVVQHSHLRESNSSLQLQHHDTTHEAATYGSMRPYRESPLLARARRTESFHSYRDFQTINLNRNVERAVPENGNLGPIQAEVKGATGECNISERKSPGVEIKSLRELDSGLEVHKIAEGFSESKKRSSEDENENKIEFRKKGGFEGGGFLGRKKVPYLASSPSTSDGGTDSPGTASPSPTKTTPSPRHKKSDSSGQEYSL

SEQ ID NO: 818869 - protein, 480 aa, Homo sapiens
MAGGHCGSFPAAAAGSGEIVQLNVGGTRFSTSRQTLMWIPDSFFSSLLSGRISTLRDETGAIFIDRDPAAFAPILNFLRTKELDLRGVSINVLRHEAEFYGITPLVRRLLLCEELERSSCGSVLFHGYLPPPGIPSRKINNTVRSADSRNGLNSTEGEARGNGTQPVLSGTGEETVRLGFPVDPRKVLIVAGHHNWIVAAYAHFAVCYRIKESSGWQQVFTSPYLDWTIERVALNAKVVGGPHGDKDKMVAVASESSIILWSVQDGGSGSEIGVFSLGVPVDALFFIGNQLVATSHTGKVGVWNAVTQHWQVQDVVPITSYDTAGSFLLLGCNNGSIYYIDMQKFPLRMKDNDLLVTELYHDPSNDAITALSVYLTPKTSVSGNWIEIAYGTSSGAVRVIVQHPETVGSGPQLFQTFTVHRSPVTKIMLSEKHLVSVCADNNHVLDVDSNTIQRNDLYSARFYSFSVIQDTIPGGDRKSW

SEQ ID NO: 818870 - protein, 815 aa, Homo sapiens; identical to SEQ ID NO: 818868

SEQ ID NO: 818871 - protein, 568 aa, Homo sapiens
MKAGDELRTTAVKESSTIFRQLGKNDQFSFKKLTVAPEYVGEVKMETGITGKVGVWNAVTQHWQVQDVVPITSYDTAGSFLLLGCNNGSIYYIDMQKFPLRMKDNDLLVTELYHDPSNDAITALSVYLTPKTSVSGNWIEIAYGTSSGAVRVIVQHPETVGSGPQLFQTFTVHRSPVTKIMLSEKHLVSVCADNNHVRTWTVTRFRGMISTQPGSTPLASFKILSLEETESHGSYSSGNDIGPFGERDDQQVFIQKVVPITNKLFVRLSSTGKRICEIQAVDCTTISSFTVRECEGSSRMGSRPRRYLFTGHTNGSIQMWDLTTAMDMVNKSEDKDVGGPTEEELLKLLDQCDLSTSRCATPNISPATSVVQHSHLRESNSSLQLQHHDTTHEAATYGSMRPYRESPLLARARRTESFHSYRDFQTINLNRNVERAVPENGNLGPIQAEVKGATGECNISERKSPGVEIKSLRELDSGLEVHKIAEGFSESKKRSSEDENENKIEFRKKGGFEGGGFLGRKKVPYLASSPSTSDGGTDSPGTASPSPTKTTPSPRHKKSDSSGQEYSL

SEQ ID NO: 818872 - protein, 815 aa, Homo sapiens; identical to SEQ ID NO: 818868

SEQ ID NO: 818873 - protein, 492 aa, Homo sapiens
TGYRSNQPSSILRHCYIDMQKFPLRMKDNDLLVTELYHDPSNDAITALSVYLTPKTSVSGNWIEIAYGTSSGAVRVIVQHPETVGSGPQLFQTFTVHRSPVTKIMLSEKHLVSVCADNNHVRTWTVTRFRGMISTQPGSTPLASFKILSLEETESHGSYSSGNDIGPFGERDDQQVFIQKVVPITNKLFVRLSSTGKRICEIQAVDCTTISSFTVRECEGSSRMGSRPRRYLFTGHTNGSIQMWDLTTAMDMVNKSEDKDVGGPTEEELLKLLDQCDLSTSRCATPNISPATSVVQHSHLRESNSSLQLQHHDTTHEAATYGSMRPYRESPLLARARRTESFHSYRDFQTINLNRNVERAVPENGNLGPIQAEVKGATGECNISERKSPGVEIKSLRELDSGLEVHKIAEGFSESKKRSSEDENENKIEFRKKGGFEGGGFLGRKKVPYLASSPSTSDGGTDSPGTASPSPTKTTPSPRHKKSDSSGQEYSL

SEQ ID NO: 818874 - protein, 815 aa, Homo sapiens; identical to SEQ ID NO: 818868

SEQ ID NO: 818875 - protein, 815 aa, Homo sapiens; identical to SEQ ID NO: 818868

SEQ ID NO: 818876 - protein, 240 aa, Homo sapiens
MAGGHCGSFPAAAAGSGEIVQLNVGGTRFSTSRQTLMWIPDSFFSSLLSGRISTLRDETGAIFIDRDPAAFAPILNFLRTKELDLRGVSINVLRHEAEFYGITPLVRRLLLCEELERSSCGSVLFHGYLPPPGIPSRKINNTVRSADSRNGLNSTEGEARGNGTQPVLSGTGEETVRLGFPVDPRKVLIVAGHHNWIVAAYAHFAVCYRVFWLGTVGHACNPSTLGGRDGWSSRSARPTW

SEQ ID NO: 818877 - protein, 700 aa, Homo sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818878 - protein, 700 aa, Homo sapiens; identical to SEQ ID NO: 818877

SEQ ID NO: 818879 - protein, 700 aa, Homo sapiens; identical to SEQ ID NO: 818877

SEQ ID NO: 818880 - protein, 700 aa, Homo sapiens; identical to SEQ ID NO: 818877

SEQ ID NO: 818881 - protein, 695 aa, Homo sapiens
MNEAVLLDWALSRAALRFSARMCAEPLSFWCWQDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818882 - protein, 676 aa, Homo sapiens
MSRRTRCEDLDELHYQDTDSDVPEQRDSKCKVKWTHEENRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818883 - protein, 676 aa, Homo sapiens; identical to SEQ ID NO: 818882

SEQ ID NO: 818884 - protein, 643 aa, Homo sapiens
MPVQVAESFESRPCQGAMDQRGRPKKVTAGTVPVHTVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818885 - protein, 642 aa, Homo sapiens
HEGYWYCTTSTLKVAELFATIHVLTGHGPPEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818886 - protein, 709 aa, Homo sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRFKAPAAPCRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818887 - protein, 561 aa, Homo sapiens
MSCTTRTQIQMCRSRGIASARSNGPMRRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818888 - protein, 523 aa, Homo sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAACGGAPSRKSGSLWLLTLWMRM

SEQ ID NO: 818889 - protein, 459 aa, Homo sapiens
SPHLSSTPSINSPSPADDYVAPAPPLICLVGPPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818890 - protein, 562 aa, Homo sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818891 - protein, 705 aa, Homo sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTREPSATSPSPDSQVEATGPCAALLPSPAVGGSWC

SEQ ID NO: 818892 - protein, 612 aa, Homo sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLRNGL

SEQ ID NO: 818893 - protein, 670 aa, Homo sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPDNCPFKLIIEDDIRPEKQKRKPGLRRSPIKKVRKSLALDIVDEDVKLMMSTLPKSLSTRAT

SEQ ID NO: 818894 - protein, 391 aa, Homo sapiens
GTRVPQGGQIYSGTSCTEAVVDTVLCRWFLREVKFTQVTPSHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818895 - protein, 312 aa, Homo sapiens
MPVQVAESFESRPCQGAMDQRGRPKRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818896 - protein, 502 aa, Homo sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAA

SEQ ID NO: 818897 - protein, 489 aa, Homo sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFCLQFDSGNGPGVGPLIPPWARGPPARNPPKLLA

SEQ ID NO: 818898 - protein, 231 aa, Homo sapiens
NLRLGTRLGGGTFWLHTGVDVSEVALQHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818899 - protein, 236 aa, Homo sapiens
MAGPWESRSSAACPRQQLVVVNGACEICILASGLLPALPRTAQLQLGWSHSPTHTQPECGASRGLPRAYPQPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818900 - protein, 123 aa, Homo sapiens
SGIKEEFEGAVVGKDRDLGSVDIISFTSSSTPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 818901 - protein, 249 aa, Homo sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAARP

SEQ ID NO: 818902 - protein, 124 aa, Homo sapiens
WCCTGRAVHGHVSLSSVLLTVEEAHSQEVTCPGSQGMWRENKKALASRGGRLITLPFPGQDHQGLLGTHSPCLDGNPLASSQMSSAWKTVACGGTRDQLFMQEKARQLLGRLKPSHTSRTLILS

SEQ ID NO: 818903 - protein, 142 aa, Homo sapiens
MTSHYVIAIFALMSFCLATAGPEPGALCELSPVSASHPVQALMESFTVLSGCASRGTTGLPQEVHVLNLRTAGQGPGQLQREHSGPQKLLHIAQELLHTEETYVKRMNLLDQVFCTRLDGCGDPSRSHSWAYSLTISSIQRF

SEQ ID NO: 818904 - protein, 850 aa, Homo sapiens [sequence omitted]

SEQ ID NO: 818905 - protein, 850 aa, Homo sapiens [sequence omitted]

SEQ ID NO: 818906 - protein, 850 aa, Homo sapiens [sequence omitted]

SEQ ID NO: 818907 - protein, 628 aa, Homo sapiens
MSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 818908 - protein, 624 aa, Homo sapiens
EIVATFWHVGLNFAFVFHHSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 818909 - protein, 400 aa, Homo sapiens
MSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDRCFSKKDYYQFPNTILLSSGFS

SEQ ID NO: 818910 - protein, 701 aa, Homo sapiens
MSAVSTPSYLLFTPFSPSKMSYLNSSKEVTYTLMSKILLSFYFPFNKSSGKACHLDSKKLCNIKKCYILEKYLAESPQEITTFYLSGSLMFPHIYPEYCKCGTESFLIGSYLSQACSLGVFLKCLTRVTGSHIYHSYNMNNCYIKNYQGDDFRKQVNFLQRLIKILGQINFRLKCTNLPKRKKKKKNRKEFQGLMCLLYQPPSVFLVLLPHHLRQTDNFKDEVEGVLNWESGELGSNPKFSHKYSCETLASHLTFLSLGFLILKVRDSADVSKISFNSNLYSEYEFNIHLVLCPALFVNSSCLLSLFGLCILITSQNYHSTVFISKPKTARIQGLWTGSVNFFWSKLYSRCREGTHSNYTKDIDIAGVVSLFILLNLNVELYSNNLFIGRKIARLGIMHVTNEDIVHKKGNISFLSSWAKYLITVNVCLWKLFACADGGKHGVPGRFKGRTVRNGQDNTFCFGRNFSWDKFPKAWIIGYEIKQIDGEKTSIVFKKYKSILFKEDKLKIKTKIKHNLGRLQELKDSMNCCEGQNQMWKLGSLRKGKAERMISQAINKELFSCAMFYDALSTDPLVLSCPQRLRLASIQSCPLILLSERTEGIQSFQSLKSRVCSSLPSNHITLCRYRIYDVLRLLMKLSLSGRMTCPWDNSPFSWSFQKYLFLGSAPGSTSTATFYSAQSSLCKARHSTNMLLASEENPWKS

SEQ ID NO: 818911 - protein, 701 aa, Homo sapiens; identical to SEQ ID NO: 818910

SEQ ID NO: 818912 - protein, 489 aa, Homo sapiens
MEQPHDEKDPASKRPHPVCLFVLPALRTHPSAQLGPLGGDAMIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 818913 - protein, 454 aa, Homo sapiens
LVRPGSMGSTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 818914 - protein, 753 aa, Homo sapiens
MEQPHDEKDPASKRPHPVCLFVLPALRTHPSAQLGPLGGDAMIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRHRHGGPLLVQHAASCLLGPHSLLLSWDLMGLLPGPLPAPHPLFGHLVVRELPRPQEDDEEMNHSSPLGSPSFIHLVSVPRELTVDGAPHGSCRHSREQSRPRLLSSPRGGRQNANKCIVSRSATCCKEHKPGKGQRVWGSGASLNGKGGLSAQLSSEKPGRRGPRDPLMDEPLQAEETAVQRPRGSSELLQEGRVRLQPNGQGQSEEQRPEPQGGSGQTLHGLRASLRFRQERDVIGSPWEQWGKLTPGSQEDSRTPPTTVSLQQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 818915 - protein, 361 aa, Homo sapiens
MTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 818916 - protein, 784 aa, Homo sapiens
MEQPHDEKDPASKRPHPVCLFVLPALRTHPSAQLGPLGGDAMIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRVRTRPCPRHQRPPGARSNPAGLLCPPSPGSQHRHGGPLLVQHAASCLLGPHSLLLSWDLMGLLPGPLPAPHPLFGHLVVRELPRPQEDDEEMNHSSPLGSPSFIHLVSVPRELTVDGAPHGSCRHSREQSRPRLLSSPRGGRQNANKCIVSRSATCCKEHKPGKGQRVWGSGASLNGKGGLSAQLSSEKPGRRGPRDPLMDEPLQAEETAVQRPRGSSELLQEGRVRLQPNGQGQSEEQRPEPQGGSGQTLHGLRASLRFRQERDVIGSPWEQWGKLTPGSQEDSRTPPTTVSLQQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 818917 - protein, 766 aa, Homo sapiens
MEQPHDEKDPASKRPHPVCLFVLPALRTHPSAQLGPLGGDAMIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRVRTRPCPRHQRPPGARSNPAGLLCPPSPGSQHRHGGPLLVQHAASCLLGPHSLLLSWDLMGLLPGPLPAPHPLFGHLVVRELPRPQEDDEEMNHSSPLGSPSFIHLVSVPRELTVDGAPHGSCRHSREQSRPRLLSSPRGGRQNANKCIVSRSATCCKEHKPGKGQRVWGSGASLNGKGGLSAQLSSEKPGRRGPRDPLMDEPLQAEETAVQRPRGSSELLQEGRVRLQPNGQGQSEEQRPEPQGGSGQTLHGLRASLRFRQERDVIGSPWEQWGKLTPGSQEDSRTPPTTVSLQQSPHDEDPQAVTYAKVKHSRPRREMASPPSPLSGEFLDTKDRQAEEDRQMDTEVSPFLSRPPGLPHPHHVPSLSLSPAAGCCI

SEQ ID NO: 818918 - protein, 692 aa, Homo sapiens
MKIFCSRANPTTGSVEWLEEDEHYDYHQEIARSSYADMLHDKDRNVKYYQGIRAAVSRVKDRGQKALVLDIGTGTGLLSMMAVTAGADFCYAIEVFKPMADAAVKIVEKNGFSDKIKVINKHSTEVTVGPEGDMPCRANILVTELFDTELIGEGALPSYEHAHRHLVEENCEAVPHRATVYAQLVESGRMWSWNKLFPIHVQTSLGEQVIVPPVDVESCPGAPSVCDIQLNQVSPADFTVLSDVLPMFSIDFSKQVSSSAACHSRRFEPLTSGRAQVVLSWWDIEMDPEGKIKCTMAPFWAHSDPEEMQWRDHWMQCVYFLPQEEPVVQGSALYLVAHHDDYCVWYSLQRTSPEKNERVRQMRPVCDCQAHLLWNRPRFGEINDQDRTDRYVQALRTVLKPDSVCLCVSDGSLLSVLAHHLGVEQVFTVESSAASHKLLRKIFKANHLEDKINIIEKRPELLTNEDLQGRKVSLLLGEPFFTTSLLPWHNLYFWYVRTAVDQHLGPGAMVMPQAASLHAVVVEFRDLWRIRSPCGDCEGFDVHIMDDMIKRALDFRESREAEPHPLWEYPCRSLSEPWQILTFDFQQPVPLQPLCAEGTVELRRPGQSHAAVLWMEYHLTPECTLSTGLLEPADPEGGCCWNPHCKQAVYFFSPAPDPRALLGGPRTVSYAVEFHPDTGDIIMEFRHADTPD

SEQ ID NO: 818919 - protein, 166 aa, Homo sapiens
QAGERYLCLAAGCLCSPQAPFCSQRALDFRESREAEPHPLWEYPCRSLSEPWQILTFDFQQPVPLQPLCAEGTVELRRPGQSHAAVLWMEYHLTPECTLSTGLLEPADPEGGCCWNPHCKQAVYFFSPAPDPRALLGGPRTVSYAVEFHPDTGDIIMEFRHADTPD

SEQ ID NO: 818920 - protein, 692 aa, Homo sapiens; identical to SEQ ID NO: 818918

SEQ ID NO: 818921 - protein, 612 aa, Homo sapiens
MAVTAGADFCYAIEVFKPMADAAVKIVEKNGFSDKIKVINKHSTEVTVGPEGDMPCRANILVTELFDTELIGEGALPSYEHAHRHLVEENCEAVPHRATVYAQLVESGRMWSWNKLFPIHVQTSLGEQVIVPPVDVESCPGAPSVCDIQLNQVSPADFTVLSDVLPMFSIDFSKQVSSSAACHSRRFEPLTSGRAQVVLSWWDIEMDPEGKIKCTMAPFWAHSDPEEMQWRDHWMQCVYFLPQEEPVVQGSALYLVAHHDDYCVWYSLQRTSPEKNERVRQMRPVCDCQAHLLWNRPRFGEINDQDRTDRYVQALRTVLKPDSVCLCVSDGSLLSVLAHHLGVEQVFTVESSAASHKLLRKIFKANHLEDKINIIEKRPELLTNEDLQGRKVSLLLGEPFFTTSLLPWHNLYFWYVRTAVDQHLGPGAMVMPQAASLHAVVVEFRDLWRIRSPCGDCEGFDVHIMDDMIKRALDFRESREAEPHPLWEYPCRSLSEPWQILTFDFQQPVPLQPLCAEGTVELRRPGQSHAAVLWMEYHLTPECTLSTGLLEPADPEGGCCWNPHCKQAVYFFSPAPDPRALLGGPRTVSYAVEFHPDTGDIIMEFRHADTPD

SEQ ID NO: 818922 - protein, 692 aa, Homo sapiens; identical to SEQ ID NO: 818918

SEQ ID NO: 818923 - protein, 618 aa, Homo sapiens
MKIFCSRANPTTGSVEWLEEDEHYDYHQEIARSSYADMLHDKDRNVKYYQGIRAAVSRVKDRGQKALVLDIGTGTGLLSMMAVTAGADFCYAIEVFKPMADAAVKIVEKNGFSDKIKVINKHSTEVTVGPEGDMPCRANILVTELFDTELIGEGALPSYEHAHRHLVEENCEAVPHRATVYAQLVESGRMWSWNKLFPIHVQTSLGEQVIVPPVDVESCPGAPSVCDIQLNQVSPADFTVLSDVLPMFSIDFSKQVSSSAACHSRRFEPLTSGRAQVVLSWWDIEMDPEGKIKCTMAPFWAHSDPEEMQWRDHWMQCVYFLPQEEPVVQGSALYLVAHHDDYCVWYSLQRTSPEKNERVRQMRPVCDCQAHLLWNRPRFGEINDQDRTDRYVQALRTVSLLLGEPFFTTSLLPWHNLYFWYVRTAVDQHLGPGAMVMPQAASLHAVVVEFRDLWRIRSPCGDCEGFDVHIMDDMIKRALDFRESREAEPHPLWEYPCRSLSEPWQILTFDFQQPVPLQPLCAEGTVELRRPGQSHAAVLWMEYHLTPECTLSTGLLEPADPEGGCCWNPHCKQAVYFFSPAPDPRALLGGPRTVSYAVEFHPDTGDIIMEFRHADTPD

SEQ ID NO: 818924 - protein, 104 aa, Homo sapiens
MKIFCSRANPTTGSVEWLEEDEHYDYHQEIARSSYADMLHDKDRNVKYYQGIRAAVSRVKDRGQKALVLDIGTGTGLLSMMAVTAGADFCYAIEVSLEAEAAPL

SEQ ID NO: 818925 - protein, 105 aa, Homo sapiens
MKIFCSRANPTTGSVEWLEEDEHYDYHQEIARSSYADMLHDKDRNVKYYQGIRAAVSRVKDRGQKALVLDIGTGTGLLSMMAVTAGADFCYAIEVSHSLQVCVLH

SEQ ID NO: 818926 - protein, 867 aa, Homo sapiens
VPPRRRCSVGSSGSPGSGPGLSVGVPSISLLLKAARAAAMAEAALLLLPEAAAERDAREKLALWDRRPDTTAPLTDRQTDSVLELKAAAENLPVPAELPIEDLCSLTSQSLPIELTSVVPESTEDILLKGFTSLGMEEERIETAQQFFSWFAKLQTQMDQDEGTKYRQMRDYLSGFQEQCDAILNDVNSALQHLESLQKQYLFVSNKTGTLHEACEQLLKEQSELVDLAENIQQKLSYFNELETINTKLNSPTLSVNSDGFIPMLAKLDDCITYISSHPNFKDYPIYLLKFKQCLSKALHLMKTYTVNTLQTLTSQLLKRDPSSVPNADNAFTLFYVKFRAAAPKVRTLIEQIELRSEKIPEYQQLLNDIHQCYLDQRELLLGPSIACTVAELTSQNNRDHCALVRSGCAFMVHVCQDEHQLYNEFFTKPTSKLDELLEKLCVSLYDVFRPLIIHVIHLETLSELCGILKNEVLEDHVQNNAEQLGAFAAGVKQMLEDVQERLVYRTHIYIQTDITGYKPAPGDLAYPDKLVMMEQIAQSLKDEQKKVPSEASFSDVHLEEGESNSLTKSGSTESLNPRPQTTISPADLHGMWYPTVRRTLVCLSKLYRCIDRAVFQGLSQEALSACIQSLLGASESISKNKTQIDGQLFLIKHLLILREQIAPFHTEFTIKEISLDLKKTRDAAFKILNPMTVPRFFRLNSNNALIEFLLEGTPEIREHYLDSKKDVDRHLKSACEQFIQQQTKLFVEQLEEFMTKVSALKTMASQGGPKYTLSQQPWAQPAKVNDLAATAYKTIKTKLPVTLRSMSLYLSNKDTEFILFKPVRNNIQQVFQKFHALLKEEFSPEDIQIIACPSMEQLSLLLSVSK

SEQ ID NO: 818927 - protein, 867 aa, Homo sapiens; identical to SEQ ID NO: 818926

SEQ ID NO: 818928 - protein, 682 aa, Homo sapiens
VPPRRRCSVGSSGSPGSGPGLSVGVPSISLLLKAARAAAMAEAALLLLPEAAAERDAREKLALWDRRPDTTAPLTDRQTDSVLELKAAAENLPVPAELPIEDLCSLTSQSLPIELTSVVPESTEDILLKGFTSLGMEEERIETAQQFFSWFAKLQTQMDQDEGTKYRQMRDYLSGFQEQCDAILNDVNSALQHLESLQKQYLFVSNKTGTLHEACEQLLKEQSELVDLAENIQQKLSYFNELETINTKLNSPTLSVNSDGFIPMLAKLDDCITYISSHPNFKDYPIYLLKFKQCLSKALHLMKTYTVNTLQTLTSQLLKRDPSSVPNADNAFTLFYVKFRAAAPKVRTLIEQIELRSEKIPEYQQLLNDIHQCYLDQRELLLGPSIACTVAELTSQNNRDHCALVRSGCAFMVHVCQDEHQLYNEFFTKPTSKLDELLEKLCVSLYDVFRPLIIHVIHLETLSELCGILKNEVLEDHVQNNAEQLGAFAAGVKQMLEDVQERLVYRTHIYIQTDITGYKPAPGDLAYPDKLVMMEQIAQSLKDEQKKVPSEASFSDVHLEEGESNSLTKSGSTESLNPRPQTTISPADLHGMWYPTVRRTLVCLSKLYRCIDRAVFQGLSQEALSACIQSLLGASESISKNKTQIDGQLFLIKHLLILREQIAPFHTEFTIKAASFLVQKEF

SEQ ID NO: 818929 - protein, 106 aa, Homo sapiens
ELRYQFDGDSPSSEASFSDVHLEEGESNSLTKSGSTESLNPRPQTTISPADLHGMWYPTVRRTLVCLSKLYRCIDRAVFQGLSQEALSACIQSLLGASESISKNKV

SEQ ID NO: 818930 - protein, 133 aa, Homo sapiens
VPPRRRCSVGSSGSPGSGPGLSVGVPSISLLLKAARAAAMAEAALLLLPEAAAERDAREKLALWDRRPDTTAPLTDRQTDSVLELKAAAENLPVPAEDMVPEVDLKSMKAQVEISLAQLSNSFIPWIIKVVCS

SEQ ID NO: 818931 - protein, 867 aa, Homo sapiens; identical to SEQ ID NO: 818926

SEQ ID NO: 818932 - protein, 643 aa, Homo sapiens
VPPRRRCSVGSSGSPGSGPGLSVGVPSISLLLKAARAAAMAEAALLLLPEAAAERDAREKLALWDRRPDTTAPLTDRQTDSVLELKAAAENLPVPAELPIEDLCSLTSQSLPIELTSVVPESTEDILLKGFTSLGMEEERIETAQQFFSWFAKLQTQMDQDEGTKYRQMRDYLSGFQEQCDAILNDVNSALQHLESLQKQYLFVSNKTGTLHEACEQLLKEQSELVDLAENIQQKLSYFNELETINTKLNSPTLSVNSDGFIPMLAKLDDCITYISSHPNFKDYPIYLLKFKQCLSKALHLMKTYTVNTLQTLTSQLLKRDPSSVPNADNAFTLFYVKFRAAAPKVRTLIEQIELRSEKIPEYQQLLNDIHQCYLDQRELLLGPSIACTVAELTSQNNRDHCALVRSGCAFMVHVCQDEHQLYNEFFTKPTSKLDELLEKLCVSLYDVFRPLIIHVIHLETLSELCGILKNEVLEDHVQNNAEQLGAFAAGVKQMLEDVQERLVYRTHIYIQTDITGYKPAPGDLAYPDKLVMMEQIAQSLKDEQKKVPSEASFSDVHLEEGESNSLTKSGSTESLNPRPQTTISPADLHGMWYPTVRRTLVCLSKLYRCIDRAVFQGLSQEALSACIQSLLGASESISKNKV

SEQ ID NO: 818933 - protein, 483 aa, Homo sapiens
VPPRRRCSVGSSGSPGSGPGLSVGVPSISLLLKAARAAAMAEAALLLLPEAAAERDAREKLALWDRRPDTTAPLTDRQTDSVLELKAAAENLPVPAELPIEDLCSLTSQSLPIELTSVVPESTEDILLKGFTSLGMEEERIETAQQFFSWFAKLQTQMDQDEGTKYRQMRDYLSGFQEQCDAILNDVNSALQHLESLQKQYLFVSNKTGTLHEACEQLLKEQSELVDLAENIQQKLSYFNELETINTKLNSPTLSVNSDGFIPMLAKLDDCITYISSHPNFKDYPIYLLKFKQCLSKALHLMKTYTVNTLQTLTSQLLKRDPSSVPNADNAFTLFYVKFRAAAPKVRTLIEQIELRSEKIPEYQQLLNDIHQCYLDQRELLLGPSIACTVAELTSQNNRDHCALVRSGCAFMVHVCQDEHQLYNEFFTKPTSKLDELLEKLCVSLYDVFRPLIIHVIHLETLSELCGILKNEVLEDHVQNNGK

SEQ ID NO: 818934 - protein, 815 aa, Homo sapiens [sequence omitted]

SEQ ID NO: 818935 - protein, 538 aa, Homo sapiens
AQVILPPRLLSSWEYRHTPPRPQLPPHVRIWDSVTLNTLHVIGIGFFDRAVTCIAFSKSNGGTNLCAVDDSNDHVLSVWDWQKEEKLADVKCSNEAVFAADFHPTDTNIIVTCGKSHLYFWTLEGSSLNKKQGLFEKQEKPKFVLCVTFSENGDTITGDSSGNILVWGKGTNRISYAVQGAHEGGIFALCMLRDGTLVSGGGKDRKLISWSGNYQKLRKTEIPEQFGPIRTVAEGKGDVILIGTTRNFVLQGTLSGDFTPITQGHTDELWGLAIHASKPQFLTCGHDKHATLWDAVGHRPVWDKIIEDPAQSSGFHPSGSVVAVGTLTGRWFVFDTETKDLVTVHTDGNEQLSVMRYSPDGNFLAIGSHDNCIYIYGVSDNGRKYTRVGKCSGHSSFITHLDWSVNSQFLVSNSGDYEILYWVPSACKQVVSVETTRDIEWATYTCTLGFHVFGVWPEGSDGTDINAVCRAHEKKLLSTGDDFGKVHLFSYPCSQFRAPSHIYGGHSSHVTNVDFLCEDSHLISTGGKDTSIMQWRVI

SEQ ID NO: 818936 - protein, 348 aa, Homo sapiens
MLRDGTLVSGGGKDRKLISWSGNYQKLRKTEIPEQFGPIRTVAEGKGDVILIGTTRNFVLQGTLSGDFTPITQGHTDELWGLAIHASKPQFLTCGHDKHATLWDAVGHRPVWDKIIEDPAQSSGFHPSGSVVAVGTLTGRWFVFDTETKDLVTVHTDGNEQLSVMRYSPDGNFLAIGSHDNCIYIYGVSDNGRKYTRVGKCSGHSSFITHLDWSVNSQFLVSNSGDYEILYWVPSACKQVVSVETTRDIEWATYTCTLGFHVFGVWPEGSDGTDINAVCRAHEKKLLSTGDDFGKVHLFSYPCSQFRAPSHIYGGHSSHVTNVDFLCEDSHLISTGGKDTSIMQWRVI

SEQ ID NO: 818937 - protein, 197 aa, Homo sapiens
MEDGFSSYSSLYDTSSLLQFCNDDSASAASSMEVTDRIASLEQRVQMQEDDIQLLKSALADVVRRLNITEEQQAVLNRKGPTKARPLMQTLPLRTTVNNGTVLPKKPTGSLPSPSGVRKETAVPATKSNIKRTSSSERVSPGGRRESNGDSRGNRNRTGSTSSSSSGKKNSERKSRPGVVAHSCNPSTSAGRSGWIT

SEQ ID NO: 818938 - protein, 151 aa, Homo sapiens
MQKRPSGARLFQQPMGSAPSSSSAFCLIAACDLEGRGAEGDTETDRGQAPGGSEAGKWDKMVYISNGQVLDSRSQSPWRLSLITDFFWGIAEFVVLFFKTLLQQDVKKRRSYGNSSDSRYDDGRGPPGNPPRRMGRINHLRGPSPPPMAGG

SEQ ID NO: 818939 - protein, 151 aa, Homo sapiens; identical to SEQ ID NO: 818938

SEQ ID NO: 818940 - protein, 97 aa, Homo sapiens
IRHGDKMVYISNGQVLDSRSQSPWRLSLITDFFWGIAEFVVLFFKTLLQQDVKKRRSYGNSSDSRYDDGRGPPGNPPRRMGRINHLRGPSPPPMAGG

SEQ ID NO: 818941 - protein, 151 aa, Homo sapiens; identical to SEQ ID NO: 818938

SEQ ID NO: 818942 - protein, 110 aa, Homo sapiens
RVRGRVGAPGGSEAGKWDKMVYISNGQVLDSRSQSPWRLSLITDFFWGIAEFVVLFFKTLLQQDVKKRRSYGNSSDSRYDDGRGPPGNPPRRMGRINHLRGPSPPPMAGG

SEQ ID NO: 818943 - protein, 110 aa, Homo sapiens; identical to SEQ ID NO: 818942

SEQ ID NO: 818944 - protein, 151 aa, Homo sapiens; identical to SEQ ID NO: 818938

SEQ ID NO: 818945 - protein, 97 aa, Homo sapiens; identical to SEQ ID NO: 818940

SEQ ID NO: 818946 - protein, 71 aa, Homo sapiens
PGLQDSARGIAEFVVLFFKTLLQQDVKKRRSYGNSSDSRYDDGRGPPGNPPRRMGRINHLRGPSPPPMAGG

SEQ ID NO: 818947 - protein, 117 aa, Homo sapiens
MQKRPSGARLFQQPMGSAPSSSSAFCLIAACDLEGRGAEGDTETDRGQAPGGSEAGKWDKMVYISNGQVLDSRSQSPWRLSLITDFFWGIAEFVVLFFKTLLQQDVKATRKPSPKNG

SEQ ID NO: 818948 - protein, 151 aa, Homo sapiens; identical to SEQ ID NO: 818938

SEQ ID NO: 818949 - protein, 110 aa, Homo sapiens
VNFVVCQLFALLAAIWFRTYLHSSKTSSFIRHVVATLLGLYLALFCFGWYALHFLVQSGISYCIMIIIGVENMHNYCFVFALGYLTVCQVTRVYIFDYGQYSADFSGSLG

SEQ ID NO: 818950 - protein, 476 aa, Homo sapiens
GGRAAASPSSSSPGTARAGERRGRPERRGPAMATTSTTGSTLLQPLSNAVQLPIDRYCFVFALGYLTVCQVTRVYIFDYGQYSADFSGPMMIITQKITSLACEIHDGMFRKDEELTSSQRDLAVRRMPSLLEYLSYNCNFMGILAGPLCSYKDYITFIEGRSYHITQSGENGKEETQYERTEPSPNTAVVQKLLVCGLSLLFHLTICTTLPVEYNIDEHFQATASWPTKIIYLYISLLAARPKYYFAWTLADAINNAAGFGFRGYDENGAARWDLISNLRIQQIEMSTSFKMFLDNWNIQTALWLKRVCYERTSFSPTIQTFILSAIWHGVYPGYYLTFLTGVLMTLAARAMRNNFRHYFIEPSQLKLFYDVITWIVTQVAISYTVVPFVLLSIKPSLTFYSSWYYCLHILGILVLLLLPVKKTQRRKNTHENIQLSQSKKFDEGENSLGQNSFSTTNNVCNQNQEIASRHSSLKQ

SEQ ID NO: 818951 - protein, 495 aa, Homo sapiens
VNFVVCQLFALLAAIWFRTYLHSSKTSSFIRHVVATLLGLYLALFCFGWYALHFLVQSGISYCIMIIIGVENMHNYCFVFALGYLTVCQVTRVYIFDYGQYSADFSGPMMIITQKITSLACEIHDGMFRKDEELTSSQRDLAVRRMPSLLEYLSYNCNFMGILAGPLCSYKDYITFIEGRSYHITQSGENGKEETQYERTEPSPNTAVVQKLLVCGLSLLFHLTICTTLPVEYNIDEHFQATASWPTKIIYLYISLLAARPKYYFAWTLADAINNAAGFGFRGYDENGAARWDLISNLRIQQIEMSTSFKMFLDNWNIQTALWLKRVCYERTSFSPTIQTFILSAIWHGVYPGYYLTFLTGVLMTLAARAMRNNFRHYFIEPSQLKLFYDVITWIVTQVAISYTVVPFVLLSIKPSLTFYSSWYYCLHILGILVLLLLPVKKTQRRKNTHENIQLSQSKKFDEGENSLGQNSFSTTNNVCNQNQEIASRHSSLKQ

SEQ ID NO: 818952 - protein, 392 aa, Homo sapiens
GGRAAASPSSSSPGTARAGERRGRPERRGPAMATTSTTGSTLLQPLSNAVQLPIDRYCFVFALGYLTVCQVTRVYIFDYGQYSADFSGPMMIITQKITSLACEIHDGMFRKDEELTSSQRDLAVRRMPSLLEYLSYNCNFMGILAGPLCSYKDYITFIEGRSYHITQSGENGKEETQYERTEPSPNTAVVQKLLVCGLSLLFHLTICTTLPVEYNIDEHFQATASWPTKIIYLYISLLAARPKYYFAWTLADAINNAAGFGFRGYDENGAARWDLISNLRIQQIEMSTSFKMFLDNWNIQTALWLKRVCYERTSFSPTIQTFILSAIWHGVYPGYYLTFLTGVLMTLAARAVSIKNFILQFNGPLELLKRLSTSLLQGRPSFLGRGQYCPFH

SEQ ID NO: 818953 - protein, 509 aa, Homo sapiens
VNFVVCQLFALLAAIWFRTYLHSSKTSSFIRHVVATLLGLYLALFCFGWYALHFLVQSGISYCIMIIIGVENMHNYCFVFALGYLTVCQVTRVYIFDYGQYSADFSGPMMIITQKITSLACEIHDGMFRKDEELTSSQRDLAVRRMPSLLEYLSYNCNFMGILAGPLCSYKDYITFIEGRSYHITQSGENGKEETQYERTEPSPNVSHEIYLEPLQHVLTAVVQKLLVCGLSLLFHLTICTTLPVEYNIDEHFQATASWPTKIIYLYISLLAARPKYYFAWTLADAINNAAGFGFRGYDENGAARWDLISNLRIQQIEMSTSFKMFLDNWNIQTALWLKRVCYERTSFSPTIQTFILSAIWHGVYPGYYLTFLTGVLMTLAARAMRNNFRHYFIEPSQLKLFYDVITWIVTQVAISYTVVPFVLLSIKPSLTFYSSWYYCLHILGILVLLLLPVKKTQRRKNTHENIQLSQSKKFDEGENSLGQNSFSTTNNVCNQNQEIASRHSSLKQ

SEQ ID NO: 818954 - protein, 299 aa, Homo sapiens
ACLACTRPRVQSPVTSTICGLSLLFHLTICTTLPVEYNIDEHFQATASWPTKIIYLYISLLAARPKYYFAWTLADAINNAAGFGFRGYDENGAARWDLISNLRIQQIEMSTSFKMFLDNWNIQTALWLKRVCYERTSFSPTIQTFILSAIWHGVYPGYYLTFLTGVLMTLAARAMRNNFRHYFIEPSQLKLFYDVITWIVTQVAISYTVVPFVLLSIKPSLTFYSSWYYCLHILGILVLLLLPVKKTQRRKNTHENIQLSQSKKFDEGENSLGQNSFSTTNNVCNQNQEIASRHSSLKQ

SEQ ID NO: 818955 - protein, 134 aa, Homo sapiens
ANVFVSLFQMRNNFRHYFIEPSQLKLFYDVITWIVTQVAISYTVVPFVLLSIKPSLTFYSSWYYCLHILGILVLLLLPVKKTQRRKNTHENIQLSQSKKFDEGENSLGQNSFSTTNNVCNQNQEIASRHSSLKQ

SEQ ID NO: 818956 - protein, 476 aa, Homo sapiens; identical to SEQ ID NO: 818950

SEQ ID NO: 818957 - protein, 476 aa, Homo sapiens; identical to SEQ ID NO: 818950

SEQ ID NO: 818958 - protein, 309 aa, Homo sapiens
GGRAAASPSSSSPGTARAGERRGRPERRGPAMATTSTTGSTLLQPLSNAVQLPIDRYCFVFALGYLTVCQVTRVYIFDYGQYSADFSGPMMIITQKITSLACEIHDGMFRKDEELTSSQRDLAVRRMPSLLEYLSYNCNFMGILAGPLCSYKDYITFIEGRSYHITQSGENGKEETQYERTEPSPNTAVVQKLLVCGLSLLFHLTICTTLPVEYNIDEHFQATASWPTKIIYLYISLLAARPKYYFAWTLADAINNAAGFGFRGYDENGAARWDLISNLRIQQIEMSTSFKMFLDNWNIQTALWLKRIF

SEQ ID NO: 818959 - protein, 476 aa, Homo sapiens; identical to SEQ ID NO: 818950

SEQ ID NO: 818960 - protein, 371 aa, Homo sapiens
GGRAAASPSSSSPGTARAGERRGRPERRGPAMATTSTTGSTLLQPLSNAVQLPIDRYCFVFALGYLTVCQVTRVYIFDYGQYSADFSGPMMIITQKITSLACEIHDGMFRKDEELTSSQRDLAVRRMPSLLEYLSYNCNFMGILAGPLCSYKDYITFIEGRSYHITQSGENGKEETQYERTEPSPNTAVVQKLLVCGLSLLFHLTICTTLPVEYNIDEHFQATASWPTKIIYLYISLLAARPKYYFAWTLADAINNAAGFGFRGYDENGAARWDLISNLRIQQIEMSTSFKMFLDNWNIQTALWLKRVCYERTSFSPTIQTFILSAIWHGVYPGYYLTFLTGVLMTLAARAMRNNLDIISLNRIAAESSRA

SEQ ID NO: 818961 - protein, 582 aa, Homo sapiens
MSPAPRPSRCLLLPLLTLGTALASLGSAQSSSFSPEAWLQQYGYLPPGDLRTHTQRSPQSLSAAIAAMQKFYGLQVTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGDSTPFDGEGGFLAHAYFPGPNIGGDTHFDSAEPWTVRNEDLNGNDIFLVAVHELGHALGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAAVVLPVLLLLLVLAVGLAVFFFRRHGTPRRLLYCQRSLLDKV

SEQ ID NO: 818962 - protein, 582 aa, Homo sapiens; identical to SEQ ID NO: 818961

SEQ ID NO: 818963 - protein, 582 aa, Homo sapiens; identical to SEQ ID NO: 818961

SEQ ID NO: 818964 - protein, 582 aa, Homo sapiens; identical to SEQ ID NO: 818961

SEQ ID NO: 818965 - protein, 582 aa, Homo sapiens; identical to SEQ ID NO: 818961

SEQ ID NO: 818966 - protein, 582 aa, Homo sapiens; identical to SEQ ID NO: 818961

SEQ ID NO: 818967 - protein, 582 aa, Homo sapiens; identical to SEQ ID NO: 818961

SEQ ID NO: 818968 - protein, 507 aa, Homo sapiens
MTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGDSTPFDGEGGFLAHAYFPGPNIGGDTHFDSAEPWTVRNEDLNGNDIFLVAVHELGHALGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAAVVLPVLLLLLVLAVGLAVFFFRRHGTPRRLLYCQRSLLDKV

SEQ ID NO: 818969 - protein, 393 aa, Homo sapiens
MRGCNWVHLGLSGLECPEPPEVRVQRLRYVRVSTLNKIRFLLARKSSERLPIGYNLGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAAVVLPVLLLLLVLAVGLAVFFFRRHGTPRRLLYCQRSLLDKV

SEQ ID NO: 818970 - protein, 582 aa, Homo sapiens; identical to SEQ ID NO: 818961

SEQ ID NO: 818971 - protein, 334 aa, Homo sapiens
MPKRRDILAIVLIVLPWTLLITVWHQSTLAPLLAVHKDEGSDPRRETPPGADPREYCTSDRDIVEVVRTEYVYTRPPPWSDTLPTIHVVTPTYSRPVQKAELTRMANTLLHVPNLHWLVVEDAPRRTPLTARLLRDTGLNYTHLHVETPRNYKLRGDARDPRIPRGTMQRNLALRWLRETFPRNSSQPGVVYFADDDNTYSLELFEEMRSTRRVSVWPVAFVGGLRYEAPRVNGAGKVVGWKTVFDPHRPFAIDMAGFAVNLRLILQRSQAYFKLRGVKGGYQESSLLRELVTLNDLEPKAANCTKILVWHTRTEKPVLVNEGKKGFTDPSVEI

SEQ ID NO: 818972 - protein, 347 aa, Homo sapiens
MGNEEPWVQPALEMPKRRDILAIVLIVLPWTLLITVWHQSTLAPLLAVHKDEGSDPRRETPPGADPREYCTSDRDIVEVVRTEYVYTRPPPWSDTLPTIHVVTPTYSRPVQKAELTRMANTLLHVPNLHWLVVEDAPRRTPLTARLLRDTGLNYTHLHVETPRNYKLRGDARDPRIPRGTMQRNLALRWLRETFPRNSSQPGVVYFADDDNTYSLELFEEMRSTRRVSVWPVAFVGGLRYEAPRVNGAGKVVGWKTVFDPHRPFAIDMAGFAVNLRLILQRSQAYFKLRGVKGGYQESSLLRELVTLNDLEPKAANCTKILVWHTRTEKPVLVNEGKKGFTDPSVEI

SEQ ID NO: 818973 - protein, 347 aa, Homo sapiens; identical to SEQ ID NO: 818972

SEQ ID NO: 818974 - protein, 2477 aa, Homo sapiens
MKSNQERSNECLPPKKREIPATSRSSEEKAPTLPSDNHRVEGTAWLPGNPGGRGHGGGRHGPAGTSVELGLQQGIGLHKALSTGLDYSPPSAPRSVPVATTLPAAYATPQPGTPVSPVQYAHLPHTFQFIGSSQYSGTYASFIPSQLIPPTANPVTSAVASAAGATTPSQRSQLEAYSTLLANMGSLSQTPGHKAEQQQQQQQQQQQQHQHQQQQQQQQQQQQQQQHLSRAPGLITPGSPPPAQQNQYVHISSSPQNTGRTASPPAIPVHLHPHQTMIPHTLTLGPPSQVVMQYADSGSHFVPREATKKAESSRLQQAIQAKEVLNGEMEKSRRYGAPSSADLGLGKAGGKSVPHPYESRHVVVHPSPSDYSSRDPSGVRASVMVLPNSNTPAADLEVQQATHREASPSTLNDKSGLHLGKPGHRSYALSPHTVIQTTHSASEPLPVGLPATAFYAGTQPPVIGYLSGQQQAITYAGSLPQHLVIPGTQPLLIPVGSTDMEASGAAPAIVTSSPQFAAVPHTFVTTALPKSENFNPEALVTQAAYPAMVQAQIHLPVVQSVASPAAAPPTLPPYFMKGSIIQLANGELKKVEDLKTEDFIQSAEISNDLKIDSSTVERIEDSHSPGVAVIQFAVGEHRAQVSVEVLVEYPFFVFGQGWSSCCPERTSQLFDLPCSKLSVGDVCISLTLKNLKNGSVKKGQPVDPASVLLKHSKADGLAGSRHRYAEQENGINQGSAQMLSENGELKFPEKMGLPAAPFLTKIEPSKPAATRKRRWSAPESRKLEKSEDEPPLTLPKPSLIPQEVKICIEGRSNVGKRGSVGERKRGSPLSFVSRLLYCRLKYTQYLHVIFLILGFCSNLVIRVTAGVSQETGAYAFSTSVCQGAGGRKGTAGAVRAPGIPGEERNGASQCLPSLAAQKQPGALTPASVRRKVPWEESCRGAGLHACGGAQALWRRVRVSFSLPPSASLSCYRHGPGGFRAVSSWGSHVQNQHQEPSFRASRRRVRWQIWKVNHLKEHFSPPTYFTIKATFNCIDIYFPLWGLTALIYIFFKEQLPHAGFHFCFLLVQRCHQGVVVDREAPAVMAPHGVRGVGGGGEGESEHPRWFLCSVRKTNQVIALTSSQEVDANCPSVRATEALHVEFAKSFCLRTLVLFIVHDYGQLGCHFFFFSDSSVTEELDFEDEHDITIFKHLKILFTLYYQASWSLIQQVLYLTLNSLGKKQKQKKLSCFLFFNTVTTFQLCRIAEEQDIESFNVVKGMNVNYELVCDNKLTTKYYLTGGTFHFDAENQFKAYAELAEKLREKGWRREYSFLSSVFLFKMNFYRTLRFAHIEFITCVIFLQFLSNNIVGKVWGTERAEINVAKFLSNLPKLYGHFIRLCSFENSFWSFYHICHKKPGLSGLLETLRIFFRFIERVFHKDIYICEQDFVLNNYFIIVVINVIFRMAFFFYSKSNRDLMFGTNPERVFHSFYTFHSQRSEISFVGFECIFKVTLKKSFISREKFLNILTWMAATKLNKYLTFLLPHENSTFFVSQIKKKIWYQPTFWLSSIHLHLGFTRTNDFYKPFSGVYQKHLNRFRIAENSSLTFLEFHYPLSMLAESWVGSFLQSYCLFSAVFFKRFCSENLLNLPYILLRALAIIRFCFSFCFLAFDGKRNTGCHIDFVLINITIYNSCGLRKTHTTFWLTSSIELTGSTKPTLRWENTHGLEQEEHHHNFCGSISGIGIKNNWFFLNTCPISFSCFFSMCNTFCANRVCPVCYIVKAHSLLAFSLFGGSSPFWPEQGWREGARRERASHLSPAADAECWGGEPSGAPCVCRHVAERASQGDPGEEPQCPLSPHGIVNVECGEEGGRFISKTHSGAMYLESTHFPRSFLQVGRPLLGVCVLETWSPASEPGREVWPVVCVRSERVGQWLWRGPPATHGHHSLVAAFSSNRKNAQRAGASCLQTLAGPEAPRAASVTASVYQTLTMTGVEILRCRSAYKDQPCASVLCPLCNIYRQPSFVLSFLFSIFKLVTAGLLRLQWNTITKKLVRAKRKKYTINKKPTNKNLSFYGISKYIKGLFLRMFNLRIISVCLGHTGAEGGGRDTEMDATYLRSFKVEIQIEFFIWTFRIIFYVGQLFVFPNSPSLVWDDLISVVVDPISNLEFEPLCFLLGECVGFFPPTRKWQHPSFSPKGTLRNLSHLFLRDGAGVCVVTLTCPEAALGLLWSRVVQFQGMFGFPASCGLLLRYRIDCNIMLHVQDDTVAPSNHKIHSLHSLIFTEICCQKFIFVVVALDFVLFCFLRKRLTIPFNICDYYRKPISFIERKISNAFEDTNTVLFQIWVRKQSSRYRRPGFLSCVGCHGYCFMNHKQLNRLVCCLLKPFAFNLHQVKTGPADSMAQFGFFGGDVKGENYTFFFFKWRGGLCFHICFYPRISEIENLRTHQVINIQRIYFFIKHMHLLLCWVGFLSFPRTVLCFWHRETPNNLHTSTPELRFLLHR

SEQ ID NO: 818975 - protein, 136 aa, Homo sapiens
EEERAEYTADIISTTVAEPYRTCFTAGGSKTSPVEQQPEQQQPQDIVSLPLPPLPHATPDPFTLYRASCIKSPGWSIQAADLFVILVQQSPPPLPLQGSASHVRSQNRKCWWTSLLAPRSSLEVPGTWCLCRSKCL

SEQ ID NO: 818976 - protein, 114 aa, Homo sapiens
EEERAEYTADIISTTVAEPYRTCFTAGGSKTSPVEQQPEQQQPQDIVSLPLPPLPHATPDPFTLYSHRTESAGGHLFLPQDLRWKSPGLGVFAVQSVYELARRHNVSPFYSGPP

SEQ ID NO: 818977 - protein, 2478 aa, Homo sapiens
MKSNQERSNECLPPKKREIPATSRSSEEKAPTLPSDNHRVEGTAWLPGNPGGRGHGGGRHGPAGTSVELGLQQGIGLHKALSTGLDYSPPSAPRSVPVATTLPAAYATPQPGTPVSPVQYAHLPHTFQFIGSSQYSGTYASFIPSQLIPPTANPVTSAVASAAGATTPSQRSQLEAYSTLLANMGSLSQTPGHKAEQQQQQQQQQQQQHQHQQQQQQQQQQQQQQQHLSRAPGLITPGSPPPAQQNQYVHISSSPQNTGRTASPPAIPVHLHPHQTMIPHTLTLGPPSQVVMQYADSGSHFVPREATKKAESSRLQQAIQAKEVLNGEMEKSRRYGAPSSADLGLGKAGGKSVPHPYESRHVVVHPSPSDYSSRDPSGVRASVMVLPNSNTPAADLEVQQATHREASPSTLNDKSGLHLGKPGHRSYALSPHTVIQTTHSASEPLPVGLPATAFYAGTQPPVIGYLSGQQQAITYAGSLPQHLVIPGTQPLLIPVGSTDMEASGAAPAIVTSSPQFAAVPHTFVTTALPKSENFNPEALVTQAAYPAMVQAQIHLPVVQSVASPAAAPPTLPPYFMKGSIIQLANGELKKVEDLKTEDFIQSAEISNDLKIDSSTVERIEDSHSPGVAVIQFAVGEHRAQVSVEVLVEYPFFVFGQGWSSCCPERTSQLFDLPCSKLSVGDVCISLTLKNLKNGSVKKGQPVDPASVLLKHSKADGLAGSRHRYAEQENGINQGSAQMLSENGELKFPEKMGLPAAPFLTKIEPSKPAATRKRRWSAPESRKLEKSEDEPPLTLPKPSLIPQEVKICIEGRSNVGKYEAAWGKGNVALPYHLYPDYCTEAKITQYLHVIFLILGFCSNLVIRVTAGVSQETGAYAFSTSVCQGAGGRKGTAGAVRAPGIPGEERNGASQCLPSLAAQKQPGALTPASVRRKVPWEESCRGAGLHACGGAQALWRRVRVSFSLPPSASLSCYRHGPGGFRAVSSWGSHVQNQHQEPSFRASRRRVRWQIWKVNHLKEHFSPPTYFTIKATFNCIDIYFPLWGLTALIYIFFKEQLPHAGFHFCFLLVQRCHQGVVVDREAPAVMAPHGVRGVGGGGEGESEHPRWFLCSVRKTNQVIALTSSQEVDANCPSVRATEALHVEFAKSFCLRTLVLFIVHDYGQLGCHFFFFSDSSVTEELDFEDEHYITIFKHLKILFTLYYQASWSLIQQVLYLTLNSLGKKQKQKKLSCFLFFNTVTTFQLCRIAEEQDIESFNVVKGMNVNYELVCDNEMTTKYYLTGGTFHFDAENQFKAYAELAEKLREKGWRREYSFLSSVFLFKMNFERTLRFAHIEFITCVIFLQFLSNNIVGKVWGTERAYINVAKFLSNLPKLYGHFIRLCSFENSFWSFYHICHKKPGLSGLLETLRIFFRFIERVFHKDIYICEQDFVLNNYFIIVVINVIFRMAFFFYSKSNRDLMFGTNPERVFHSFETFHSQRSEISFVGFECIFKVTLKKSFISREKFLNILTWMAATKLNKYLTFLLPPLKIVLSSFHKLKKKSGINPHFGCLSIHLHLGFTRTNDFYKPFSGVYQKHLNRFRIAENSSLTFLEFHYPLSMLAESWVGSFLQSYCLFSAVFFKRFCSENLLNLPYILLRALAIIRFCFSFCFLAFDGKRNTGCHIDFVLINITIYNSCGLRKTHTTFWLTSSIELTGSTKPTLRWENTHGLEQEEHHHNFCGSISGIGIKNNWFFLNTCPISFSCFFSMCNTFCANRVCPVCYIVKAHSLLAFSLFGGSSPFWPEQGWREGARRERASHLSPAADAECWGGEPSGAPCVCRHVAERASQGDPGEEPQCPLSPHGIVNVECGEEGGRFISKTHSGAMYLESTHFPRSFLQVGRPLLGVCVLETWSPASEPGREVWPVVCVRSERVGQWLWRGPPATHGHHSLVAAFSSNRKNAQRAGASCLQTLAGPEAPRAASVTASVQQTLTMTGVEILRCRSAYKDQPCASVLCPLCNIYRQPSFVLSFLFSIFKLVTAGLLRLQWNTITKKLVRAKRKKYTINKKPTNKNLSFYGISKYIKGLFLRMFNLRIISVCLGHTGAEGGGRDTEMDATYLRSFKVEIQIEFFIWTFRIIFYVGQLFVFPNSPSLVWDDLISVVVDPISNLEFEPLCFLLGECVGFFPPTRKWQHPSFSPKGTLRNLSHLFLRDGAGVCVVTLTCPEAALGLLWSRVVQFQGMFGFPASCGLLLRYRIDCNIMLHVQDDTVAPSNHKIHSLHSLIFTEICCQKFIFVVVALDFVLFCFLRKRLTIPFNICDYYRKPISFIERKISNAFEDTNTVLFQIWVRKQSSRYRRPGFLSCVGCHGYCFMNHKQLNRLVCCLLKPFALQFAQVKTGPADSMAQFGFFGGDVKGENYTFFFFKWRGGLCFHICFEPRISEIENLRTHQVINIQRIYFFIKHMHLLLCWVGFLSFPRTVLCFWHRETPNNLHTSTPELRFLLHR

SEQ ID NO: 818978 - protein, 2478 aa, Homo sapiens
MKSNQERSNECLPPKKREIPATSRSSEEKAPTLPSDNHRVEGTAWLPGNPGGRGHGGGRHGPAGTSVELGLQQGIGLHKALSTGLDYSPPSAPRSVPVATTLPAAYATPQPGTPVSPVQYAHLPHTFQFIGSSQYSGTYASFIPSQLIPPTANPVTSAVASAAGATTPSQRSQLEAYSTLLANMGSLSQTPGHKAEQQQQQQQQQQQQHQHQQQQQQQQQQQQQQQHLSRAPGLITPGSPPPAQQNQYVHISSSPQNTGRTASPPAIPVHLHPHQTMIPHTLTLGPPSQVVMQYADSGSHFVPREATKKAESSRLQQAIQAKEVLNGEMEKSRRYGAPSSADLGLGKAGGKSVPHPYESRHVVVHPSPSDYSSRDPSGVRASVMVLPNSNTPAADLEVQQATHREASPSTLNDKSGLHLGKPGHRSYALSPHTVIQTTHSASEPLPVGLPATAFYAGTQPPVIGYLSGQQQAITYAGSLPQHLVIPGTQPLLIPVGSTDMEASGAAPAIVTSSPQFAAVPHTFVTTALPKSENFNPEALVTQAAYPAMVQAQIHLPVVQSVASPAAAPPTLPPYFMKGSIIQLANGELKKVEDLKTEDFIQSAEISNDLKIDSSTVERIEDSHSPGVAVIQFAVGEHRAQVSVEVLVEYPFFVFGQGWSSCCPERTSQLFDLPCSKLSVGDVCISLTLKNLKNGSVKKGQPVDPASVLLKHSKADGLAGSRHRYAEQENGINQGSAQMLSENGELKFPEKMGLPAAPFLTKIEPSKPAATRKRRWSAPESRKLEKSEDEPPLTLPKPSLIPQEVKICIEGRSNVGKYEAAWGKGNVALPYHLYPDYCTEAKITQYLHVIFLILGFCSNLVIRVTAGVSQETGAYAFSTSVCQGAGGRKGTAGAVRAPGIPGEERNGASQCLPSLAAQKQPGALTPASVRRKVPWEESCRGAGLHACGGAQALWRRVRVSFSLPPSASLSCYRHGPGGFRAVSSWGSHVQNQHQEPSFRASRRRVRWQIWKVNHLKEHFSPPTYFTIKATFNCIDIYFPLWGLTALIYIFFKEQLPHAGFHFCFLLVQRCHQGVVVDREAPAVMAPHGVRGVGGGGEGESEHPRWFLCSVRKTNQVIALTSSQEVDANCPSVRATEALHVEFAKSFCLRTLVLFIVHDYGQLGCHFFFFSDSSVTEELDFEDEHDITIFKHLKILFTLYYQASWSLIQQVLYLTLNSLGKKQKQKKLSCFLFFNTVTTFQLCRIAEEQDIESFNVVKGMNVNYELVCDNEMTTKYYLTGGTFHFDAENQFKAYAELAEKLREKGWRREYSFLSSVFLFKMNFERTLRFAHIEFITCVIFLQFLSNNIVGKVWGTERALINVAKFLSNLPKLYGHFIRLCSFENSFWSFYHICHKKPGLSGLLETLRIFFRFIERVFHKDIYICEQDFVLNNYFIIVVINVIFRMAFFFLFKIKSRFNVWYKTQKGYFIVFKPFIPRDPKYHLWVLNASLKCFKKKFYKREKFLNILTWMAATKLNKYLTFLLPPLKIVLSSFHKLKKKSGINPHFGCLSIHLHLGFTRTNDFYKPFSGVYQKHLNRFRIAENSSLTFLEFHYPLSMLAESWVGSFLQSYCLFSAVFFKRFCSENLLNLPYILLRALAIIRFCFSFCFLAFDGKRNTGCHIDFVLINITIYNSCGLRKTHTTFWLTSSIELTGSTKPTLRWENTHGLEQEEHHHNFCGSISGIGIKNNWFFLNTCPISFSCFFSMCNTFCANRVCPVCYIVKAHSLLAFSLFGGSSPFWPEQGWREGARRERASHLSPAADAECWGGEPSGAPCVCRHVAERASQGDPGEEPQCPLSPHGIVNVECGEEGGRFISKTHSGAMYLESTHFPRSFLQVGRPLLGVCVLETWSPASEPGREVWPVVCVRSERVGQWLWRGPPATHGHHSLVAAFSSNRKNAQRAGASCLQTLAGPEAPRAASVTASVQQTLTMTGVEILRCRSAYKDQPCASVLCPLCNIYRQPSFVLSFLFSIFKLVTAGLLRLQWNTITKKLVRAKRKKYTINKKPTNKNLSFYGISKYIKGLFLRMFNLRIISVCLGHTGAEGGGRDTEMDATYLRSFKVEIQIEFFIWTFRIIFYVGQLFVFPNSPSLVWDDLISVVVDPISNLEFEPLCFLLGECVGFFPPTRKWQHPSFSPKGTLRNLSHLFLRDGAGVCVVTLTCPEAALGLLWSRVVQFQGMFGFPASCGLLLRYRIDCNIMLHVQDDTVAPSNHKIHSLHSLIFTEICCQKFIFVVVALDFVLFCFLRKRLTIPFNICDYYRKPISFIERKISNAFEDTNTVLFQIWVRKQSSRYRRPGFLSCVGCHGYCFMNHKQLNRLVCCLLKPFALQFAQVKTGPADSMAQFGFFGGDVKGENYTFFFFKWRGGLCFHICFYPRISEIENLRTHQVINIQRIYFFIKHMHLLLCWVGFLSFPRTVLCFWHRETPNNLHTSTPELRFLLHR

SEQ ID NO: 818979 - protein, 2477 aa, Homo sapiens
MKSNQERSNECLPPKKREIPATSRSSEEKAPTLPSDNHRVEGTAWLPGNPGGRGHGGGRHGPAGTSVELGLQQGIGLHKALSTGLDYSPPSAPRSVPVATTLPAAYATPQPGTPVSPVQYAHLPHTFQFIGSSQYSGTYASFIPSQLIPPTANPVTSAVASAAGATTPSQRSQLEAYSTLLANMGSLSQTPGHKAEQQQQQQQQQQQQHQHQQQQQQQQQQQQQQQHLSRAPGLITPGSPPPAQQNQYVHISSSPQNTGRTASPPAIPVHLHPHQTMIPHTLTLGPPSQVVMQYADSGSHFVPREATKKAESSRLQQAIQAKEVLNGEMEKSRRYGAPSSADLGLGKAGGKSVPHPYESRHVVVHPSPSDYSSRDPSGVRASVMVLPNSNTPAADLEVQQATHREASPSTLNDKSGLHLGKPGHRSYALSPHTVIQTTHSASEPLPVGLPATAFYAGTQPPVIGYLSGQQQAITYAGSLPQHLVIPGTQPLLIPVGSTDMEASGAAPAIVTSSPQFAAVPHTFVTTALPKSENFNPEALVTQAAYPAMVQAQIHLPVVQSVASPAAAPPTLPPYFMKGSIIQLANGELKKVEDLKTEDFIQSAEISNDLKIDSSTVERIEDSHSPGVAVIQFAVGEHRAQVSVEVLVEYPFFVFGQGWSSCCPERTSQLFDLPCSKLSVGDVCISLTLKNLKNGSVKKGQPVDPASVLLKHSKADGLAGSRHRYAEQENGINQGSAQMLSENGELKFPEKMGLPAAPFLTKIEPSKPAATRKRRWSAPESRKLEKSEDEPPLTLPKPSLIPQEVKICIEGRSNVGKYEAAWGKGNVALPYHLYPDYCTEAKITQYLHVIFLILGFCSNLVIRVTAGVSQETGAYAFSTSVCQGAGGRKGTAGAVRAPGIPGEERNGASQCLPSLAAQKQPGALTPASVRRKVPWEESCRGAGLHACGGAQALWRRVRVSFSLPPSASLSCYRHGPGGFRAVSSWGSHVQNQHQEPSFRASRRRVRWQIWKVNHLKEHFSPPTYFTIKATFNCIDIYFPLWGLTALIYIFFKEQLPHAGFHFCFLLVQRCHQGVVVDREAPAVMAPHGVRGVGGGGEGESEHPRWFLCSVRKTNQVIALTSSQEVDANCPSVRATEALHVEFAKSFCLRTLVLFIVHDYGQLGCHFFFFSDSSVTEELDFEDEHDITIFKHLKILFTLYYQASWSLIQQVLYLTLNSLGKKQKQKKLSCFLFFNTVTTFQLCRIAEEQDIESFNVVKGMNVNYELVCDNEMTTKYYLTGGTFHFDVWNQFKAYAELAEKLREKGWRREYSFLSSVFLFKMNFERTLRFAHIEFITCVIFLQFLSNNIVGKVWGTERAEINVAKFLSNLPKLYGHFIRLCSFENSFWSFYHICHKKPGLSGLLETLRIFFRFIERVFHKDIYICEQDFVLNNYFIIVVINVIFRMAFFFYSKSNRDLMFGTNPERVFHSFETFHSQRSEISFVGFECIFKVTLKKSFISREKFLNILTWMAATKLNKYLTFLFPIENSTFFVSQIKKKIWYQPTFWLSSIHLHLGFTRTNDFYKPFSGVYQKHLNRFRIAENSSLTFLEFHYPLSMLAESWVGSFLQSYCLFSAVFFKRFCSENLLNLPYILLRALAIIRFCFSFCFLAFDGKRNTGCHIDFVLINITIYNSCGLRKTHTTFWLTSSIELTGSTKPTLRWENTHGLEQEEHHHNFCGSISGIGIIKYWFFLNTCPISFSCFFSMCNTFCANRVCPVCYIVKAHSLLAFSLFGGSSPFWPEQGWREGARRERASHLSPAADAECWGGEPSGAPCVCRHVAERASQGDPGEEPQCPLSPHGIVNVECGEEGGRFISKTHSGAMYLESTHFPRSFLQVGRPLLGVCVLETWSPASEPGREVWPVVCVRSERVGQWLWRGPPATHGHHSLVAAFSSNRKNAQRAGASCLQTLAGPEAPRAASVTASVQQTLTMTGVEILRCRSAYKDQPCASVLCPLCNIYRQPSFVLSFLFSIFKLVTAGLLRLQWNTITKKLVRAKKKKIILLIRNQQTRTSLSRDFKIYKMMFLRMFNLRIISVCLGHTGAEGGGRDTEMDATYLRSFKVEIQIEFFIWTFRIIFYVGQLFVFPNSPSLVWDDLISVVVDPISNLDCEPLCFLLGECVGFFPPTRKWQHPSFSPKGTLRNLSHLFLRDGAGVCVVTLTCPEAALGLLWSRVVQFQGMFGFPASCGLLLRYRIDCNIMLHVQDDTVAPSNHKIHSLHSLIFTEICCQKFIFVVVALDFVLFCFLRKRLTIPFNICDYYRKPISFIERKISNAFEDTNTVLFQIWVRKQSSRYRRPGFLSCVGCHGYCFMNHKQLNRLVCCLLKPFAFNLHQVKTGPADSMAQFGFFGGDVKGENYTFFFFKWRGGLCFHICFEPRISEIENLRTHQVINIQRIYFFIKHMHLLLCWVGFLSFPRTVLCFWHRETPNNLHTSTPELRFLLHR

SEQ ID NO: 818980 - protein, 2477 aa, Homo sapiens
MKSNQERSNECLPPKKREIPATSRSSEEKAPTLPSDNHRVEGTAWLPGNPGGRGHGGGRHGPAGTSVELGLQQGIGLHKALSTGLDYSPPSAPRSVPVATTLPAAYATPQPGTPVSPVQYAHLPHTFQFIGSSQYSGTYASFIPSQLIPPTANPVTSAVASAAGATTPSQRSQLEAYSTLLANMGSLSQTPGHKAEQQQQQQQQQQQQHQHQQQQQQQQQQQQQQQHLSRAPGLITPGSPPPAQQNQYVHISSSPQNTGRTASPPAIPVHLHPHQTMIPHTLTLGPPSQVVMQYADSGSHFVPREATKKAESSRLQQAIQAKEVLNGEMEKSRRYGAPSSADLGLGKAGGKSVPHPYESRHVVVHPSPSDYSSRDPSGVRASVMVLPNSNTPAADLEVQQATHREASPSTLNDKSGLHLGKPGHRSYALSPHTVIQTTHSASEPLPVGLPATAFYAGTQPPVIGYLSGQQQAITYAGSLPQHLVIPGTQPLLIPVGSTDMEASGAAPAIVTSSPQFAAVPHTFVTTALPKSENFNPEALVTQAAYPAMVQAQIHLPVVQSVASPAAAPPTLPPYFMKGSIIQLANGELKKVEDLKTEDFIQSAEISNDLKIDSSTVERIEDSHSPGVAVIQFAVGEHRAQVSVEVLVEYPFFVFGQGWSSCCPERTSQLFDLPCSKLSVGDVCISLTLKNLKNGSVKKGQPVDPASVLLKHSKADGLAGSRHRYAEQENGINQGSAQMLSENGELKFPEKMGLPAAPFLTKIEPSKPAATRKRRWSAPESRKLEKSEDEPPLTLPKPSLIPQEVKICIEGRSNVGKYEAAWGKGNVALPYHLYPDYCTVAKITQYLHVIFLILGFCSNLVIRVTAGVSQETGAYAFSTSVCQGAGGRKGTAGAVRAPGIPGEERNGASQCLPSLAAQKQPGALTPASVRRKVPWEESCRGAGLHACGGAQALWRRVRVSFSLPPSASLSCYRHGPGGFRAVSSWGSHVQNQHQEPSFRASRRRVRWQIWKVNHLKEHFSPPTYFTIKATFNCIDIYFPLWGLTALIYIFFKEQLPHAGFHFCFLLVQRCHQGVVVDREAPAVMAPHGVRGVGGGGEGESEHPRWFLCSVRKTNQVIALTSSQEVDANCPSVRATEALHVEFAKSFCLRTLVLFIVHDYGQLGCHFFFFSDSSVTEELDFEDEHDITIFKHLKILFTLYYQASWSLIQQVLYLTLNSLGKKQKQKKLSCFLFFNTVTTFQLCRIAEEQDIESFNVVKGMNVNYELVCDNEMTTKYYLTGGTFHFDVWNQFKAYAELAEKLREKGWRREYSFLSSVFLFKMNFERTLRFAHIEFITCVIFLQFLSNNIVGKVWGTERAEINVAKFLSNLPKLYGHFIRLCSFENSFWSFYHICHKKPGLSGLLETLRIFFRFIERVFHKDIYICEQDFVLNNYFIIVVINVIFRMAFFFYSKSNRDLMFGTNPERVFHSFETFHSQRSEISFVGFECIFKVTLKKSFISREKFLNILTWMAATKLNKYLTFLFPIENSTFFVSQIKKKIWYQPTFWLSSIHLHLGFTRTNDFYKPFSGVYQKHLNRFRIAENSSLTFLEFHYPLSMLAESWVGSFLQSYCLFSAVFFKRFCSENLLNLPYILLRALAIIRFCFSFCFLAFDGKRNTGCHIDFVLINITIYNSCGLRKTHTTFWLTSSIELTGSTKPTLRWENTHGLEQEEHHHNFCGSISGIGIKNNWFFLNTCPISFSCFFSMCNTFCANRVRPVCYIVKAHSLLAFSLFGGSSPFWPEQGWREGARRERASHLSPAADAECWGGEPSGAPCVCRHVAERASQGDPGEEPQCPLSPHGIVNVECGEEGGRFISKTHSGAMYLESTHFPRSFLQVGRPLLGVCVLETWSPASEPGREVWPVVCVRSERVGQWLWRGPPATHGHHSLVAAFSSNRKNAQRAGASCLQTLAGPEAPRAASVTASVQQTLTMTGVEILRCRSAYKDQPCASVLCPLCNIYRQPSFVLSFLFSIFKLVTAGLLRLQWNTITKKLVRAKEKNNTINKKPTNKNLSFYGISKYIKGLFLRMFNLRIISVCLGHTGAEGGGRDTEMDATYLRSFKVEIQIEFFIWTFRIIFYVGQLFVFPNSPSLVWDDLISVVVDPISNLEFEPLCFLLGECVGFFPPTRKWQHPSFSPKGTLRNLSHLFLRDGAGVCVVQLTCPEAALGLLWSRVVQFQGMFGFPASCGLLLRYRIDCNIMLHVQDDTVAPSNHKIHSLHSLIFTEICCQKFIFVVVALDFVLFCFLRKRLTIPFNICDYYRKPISFIERKISNAFEDTNTVLFQIWVRKQSSRYRRPGFLSCVGCHGYCFMNHKQLNRLVCCLLKPFAFNLHQVKTGPADSMAQFGFFGGDVKGENYTFFFFKWRGGLCFHICFEPRISEIENLRTHQVINIQRIYFFIKHMHLLLCWVGFLSFPRTVLCFWHRETPNNLHTSTPELRFLLHR

SEQ ID NO: 818981 - protein, 2478 aa, Homo sapiens; identical to SEQ ID NO: 818977

SEQ ID NO: 818982 - protein, 2478 aa, Homo sapiens; identical to SEQ ID NO: 818977

SEQ ID NO: 818983 - protein, 137 aa, Homo sapiens
TNKWRLSAHVCSCFFPDTAIQFVIRAMTGVCLKISAFELDTCAFSSVNTALFGGVSSSPQPELLNSKPKLVSAERRFQDSPVSICGDLQIRQSSFPASGVLAPEPSLRLVLLDVLISDHYPPYASHRPRENRHQNLG

SEQ ID NO: 818984 - protein, 136 aa, Homo sapiens; identical to SEQ ID NO: 818975

SEQ ID NO: 818985 - protein, 816 aa, Homo sapiens
MKSNQERSNECLPPKKREIPATSRSSEEKAPTLPSDNHRVEGTAWLPGNPGGRGHGGGRHGPAGTSVELGLQQGIGLHKALSTGLDYSPPSAPRSVPVATTLPAAYATPQPGTPVSPVQYAHLPHTFQFIGSSQYSGTYASFIPSQLIPPTANPVTSAVASAAGATTPSQRSQLEAYSTLLANMGSLSQTPGHKAEQQQQQQQQQQQQHQHQQQQQQQQQQQQQQQHLSRAPGLITPGSPPPAQQNQYVHISSSPQNTGRTASPPAIPVHLHPHQTMIPHTLTLGPPSQVVMQYADSGSHFVPREATKKAESSRLQQAIQAKEVLNGEMEKSRRYGAPSSADLGLGKAGGKSVPHPYESRHVVVHPSPSDYSSRDPSGVRASVMVLPNSNTPAADLEVQQATHREASPSTLNDKSGLHLGKPGHRSYALSPHTVIQTTHSASEPLPVGLPATAFYAGTQPPVIGYLSGQQQAITYAGSLPQHLVIPGTQPLLIPVGSTDMEASGAAPAIVTSSPQFAAVPHTFVTTALPKSENFNPEALVTQAAYPAMVQAQIHLPVVQSVASPAAAPPTLPPYFMKGSIIQLANGELKKVEDLKTEDFIQSAEISNDLKIDSSTVERIEDSHSPGVAVIQFAVGEHRAQVSVEVLVEYPFFVFGQGWSSCCPERTSQLFDLPCSKLSVGDVCISLTLKNLKNGSVKKGQPVDPASVLLKHSKADGLAGSRHRYAEQENGINQGSAQMLSENGELKFPEKMGLPAAPFLTKIEPSKPAATRKRRWSAPESRKLEKSEDEPPLTLPKPSLIPQEVKICIEGRSNVGK

SEQ ID NO: 818986 - protein, 598 aa, Homo sapiens
SAAARLPAEVRAPSRGWRGASGFRGAKPGAPSPAELGASMAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTLPNMFGNLRSTLMALMIGSYASSAITFPGIKLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPERSVPLRKSLCSPTFLWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYAANGMGPLKVLSGSEVTA

SEQ ID NO: 818987 - protein, 111 aa, Homo sapiens
MAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGR

SEQ ID NO: 818988 - protein, 598 aa, Homo sapiens; identical to SEQ ID NO: 818986

SEQ ID NO: 818989 - protein, 575 aa, Homo sapiens
MRIPSPPGRSDWLGASMAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTLPNMFGNLRSTLMALMIGSYASSAITFPGIKLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPERSVPLRKSLCSPTFLWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYAANGMGPLKVLSGSEVTA

SEQ ID NO: 818990 - protein, 559 aa, Homo sapiens
MAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTLPNMFGNLRSTLMALMIGSYASSAITFPGIKLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPERSVPLRKSLCSPTFLWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYAANGMGPLKVLSGSEVTA

SEQ ID NO: 818991 - protein, 585 aa, Homo sapiens
SAAARLPAEVRAPSRGWRGASGFRGAKPGAPSPAELGASMAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTLPNMFGNLRSTLMALMIGSYASSAITFPGIKLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPEILWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYAANGMGPLKVLSGSEVTA

SEQ ID NO: 818992 - protein, 598 aa, Homo sapiens
ATGRWGRRVALNLPFFLPASRGLSWRESPDMGPRCFRARSAPCCPLGTWADADFLPSSPALSALAGLGASMAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPERSVPLRKSLCSPTFLWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYAANGMGPLKVLSGSEVTA

SEQ ID NO: 818993 - protein, 485 aa, Homo sapiens
MLNLGFTIGSFVLSATTLPLGILMDRFGPRPVRLVGSACFTASCTLMALASRDVEALSPLIFLALSLNGFGGICLTFTSLTLPNMFGNLRSTLMALMIGSYASSAITFPGIKLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPERSVPLRKSLCSPTFLWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYAANGMGPLKVLSGSEVTA

SEQ ID NO: 818994 - protein, 401 aa, Homo sapiens
MFGNLRSTLMALMIGSYASSAITFPGIKLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPERSVPLRKSLCSPTFLWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYAANGMGPLKVLSGSEVTA

SEQ ID NO: 818995 - protein, 613 aa, Homo sapiens
SAAARLPAEVRAPSRGWRGASGFRGAKPGAPSPAELGASMAPTLQQAYRRRWWMACTAVLENLFFSAVLLGWGSLLIILKNEGFYSSTCPAVPGVMCWALPSPSSAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTLPNMFGNLRSTLMALMIGSYASSAITFPGIKLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPERSVPLRKSLCSPTFLWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYAANGMGPLKVLSGSEVTA

SEQ ID NO: 818996 - protein, 303 aa, Homo sapiens
MGQRLSQKAPSLEDGSDAFMSPQDVRGTSENLPERSVPLRKSLCSPTFLWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYAANGMGPLKVLSGSEVTA

SEQ ID NO: 818997 - protein, 303 aa, Homo sapiens; identical to SEQ ID NO: 818996

SEQ ID NO: 818998 - protein, 509 aa, Homo sapiens
SAAARLPAEVRAPSRGWRGASGFRGAKPGAPSPAELGASMAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTLPNMFGNLRSTLMALMIGSYASSAITFPGIKLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPERSVPLRKSLCSPTFLWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAV

SEQ ID NO: 818999 - protein, 274 aa, Homo sapiens
SAAARLPAEVRAPSRGWRGASGFRGAKPGAPSPAELGASMAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTLPNMFGNLRSTLMALMIGSYASSAITFPGIKLIYDAGVAFVVIMFTWSGLACLIFLNCTLNWPIEAFPAPEEVNYTGRSS

SEQ ID NO: 819000 - protein, 248 aa, Homo sapiens
MRIPSPPGRSDWLGASMAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTGRGCYQIHQTTLLQDPKAHQCHQCLHPDQPAACGFWHHLSHQQLTPPVCDLCPAHHCSRFLPLSLWESLCCSVSLLG

SEQ ID NO: 819001 - protein, 197 aa, Homo sapiens
MRIPSPPGRSDWLGASMAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTVSVTGLAWQQSSPEWGEGRVSGVRAV

SEQ ID NO: 819002 - protein, 329 aa, Homo sapiens
AVRLRYSPIAVVMVGEAGRDLRRRRAVAVTAEKMAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 819003 - protein, 136 aa, Homo sapiens
AVRLRYSPIAVVMVGEAGRDLRRRRAVAVTAEKMAVLAPLIALVYSVPRLSRWLAQPYYLLSALLSAAFLLVRKLPPLCHGLPTQREDGNPCDFDWREVEILMFLSAIVMMKNRRSTLSFLLPPCCGGWDASSMIF

SEQ ID NO: 819004 - protein, 100 aa, Homo sapiens
SVYYCPCGDLSKPGLACSGLRYNCTGLNFGKVDVGRYTDVSTRYKVSTSPLTKQLPTLILFQGGKEAMRRPQIDKKGRAVSWTFSEVPERKGRCMKGAEQ

SEQ ID NO: 819005 - protein, 329 aa, Homo sapiens; identical to SEQ ID NO: 819002

SEQ ID NO: 819006 - protein, 329 aa, Homo sapiens; identical to SEQ ID NO: 819002

SEQ ID NO: 819007 - protein, 329 aa, Homo sapiens; identical to SEQ ID NO: 819002

SEQ ID NO: 819008 - protein, 329 aa, Homo sapiens; identical to SEQ ID NO: 819002

SEQ ID NO: 819009 - protein, 329 aa, Homo sapiens; identical to SEQ ID NO: 819002

SEQ ID NO: 819010 - protein, 329 aa, Homo sapiens; identical to SEQ ID NO: 819002

SEQ ID NO: 819011 - protein, 329 aa, Homo sapiens; identical to SEQ ID NO: 819002

SEQ ID NO: 819012 - protein, 329 aa, Homo sapiens; identical to SEQ ID NO: 819002

SEQ ID NO: 819013 - protein, 329 aa, Homo sapiens; identical to SEQ ID NO: 819002

SEQ ID NO: 819014 - protein, 329 aa, Homo sapiens; identical to SEQ ID NO: 819002

SEQ ID NO: 819015 - protein, 329 aa, Homo sapiens; identical to SEQ ID NO: 819002

SEQ ID NO: 819016 - protein, 329 aa, Homo sapiens; identical to SEQ ID NO: 819002

SEQ ID NO: 819017 - protein, 287 aa, Homo sapiens
LGDQRIPEAQKGSQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 819018 - protein, 202 aa, Homo sapiens
MFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 819019 - protein, 279 aa, Homo sapiens
MVGEAGRDLRRRRAVAVTAEKMAVLAPLIALVYSVPRLSRWLAQPYYLLSALLSAAFLLVRKLPPLCHGLPTQREDGNPCDFDWREVEILMFLSAIVMMKNRRSMFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 819020 - protein, 202 aa, Homo sapiens; identical to SEQ ID NO: 819018

SEQ ID NO: 819021 - protein, 336 aa, Homo sapiens
AVRLRYSPIAVVMVGEAGRDLRRRRAVAVTAEKMAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRELSGPCRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 819022 - protein, 329 aa, Homo sapiens; identical to SEQ ID NO: 819002

SEQ ID NO: 819023 - protein, 329 aa, Homo sapiens; identical to SEQ ID NO: 819002

SEQ ID NO: 819024 - protein, 329 aa, Homo sapiens; identical to SEQ ID NO: 819002

SEQ ID NO: 819025 - protein, 209 aa, Homo sapiens
MFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRELSGPCRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 819026 - protein, 107 aa, Homo sapiens
MVGEAGRDLRRRRAVAVTAEKMAVLAPLIALVYSVPRLSRWLAQPYYLLSALLSAAFLLVRKLPPLCHGLPTQREDGNPCDFDWREVEILMFLSAIVMMKNRRSSTK

SEQ ID NO: 819027 - protein, 102 aa, Homo sapiens
GCCKLGSGRHARTSGLVTLGKQLPTLILFQGGKEAMRRPQIDKKGRAVSWTFSEENVIREFNLNELYQRAKKLSKAGDNIPEEQPVASTPTTVSDGENKKDK

SEQ ID NO: 819028 - protein, 71 aa, Homo sapiens
AVSRGSLSLIAQERTGCLMDFSEENVIREFNLNELYQRAKKLSKAGDNIPEEQPVASTPTTVSDGENKKDK

SEQ ID NO: 819029 - protein, 329 aa, Homo sapiens; identical to SEQ ID NO: 819002

SEQ ID NO: 819030 - protein, 283 aa, Homo sapiens
MVGEAGRDLRRRRAVAVTAEKMAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEVPERKGRCMKGAEQ

SEQ ID NO: 819031 - protein, 241 aa, Homo sapiens
MVGEAGRDLRRRRAVAVTAEKMAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRKGGHITPHQATPQSK

SEQ ID NO: 819032 - protein, 139 aa, Homo sapiens
AVRLRYSPIAVVMVGEAGRDLRRRRAVAVTAEKMAVLAPLIALVYSVPRLSRWLAQPYYLLSALLSAAFLLVRKLPPLCHGLPTQREDGNPCDFDWREVEILMFLSAIVMMKNRRSSKFSSLLRLKVRSNALWRCFASC

SEQ ID NO: 819033 - protein, 197 aa, Homo sapiens
MDPPAGFVRAGNPAVAAPQSPLSPEGAHFRAAHHPRSTGSRCPGSLQPSRPLVANWLQSLPEMPVDFTGYWKMLVNENFEEYLRALDVNVALRKIANLLKPDKEIVQDGDHMIIRTLSTFRNYIMDFQVGKEFEEDLTGIDDRKCMTTVSWDGDKLQCVQKGEKEGRGWTQWIEGDELHLEMRVEGVVCKQVFKKVQ

SEQ ID NO: 819034 - protein, 197 aa, Homo sapiens; identical to SEQ ID NO: 819033

SEQ ID NO: 819035 - protein, 220 aa, Homo sapiens
MDPPAGFVRAGNPAVAAPQSPLSPEGAHFRAAHHPRSTGSRCPGSLQPSRPLVANWLQSLPEMPVDFTGYWKMLVNENFEEYLRALDVNVALRKIANLLKPDKEIVQDGDHMIIRTLSTFRNYIMDFQVGKEFEEDLTGIDDRKCMTTVSWDGDKLQCVQKGEKEGRGWTQWIEGDELHLEIKVTCVLCKHFIEQGAKLARLTTYDEWITTKFSPGIPCS

SEQ ID NO: 819036 - protein, 157 aa, Homo sapiens
MDPPAGFVRAGNPAVAAPQSPLSPEGAHFRAAHHPRSTGSRCPGSLQPSRPLVANWLQSLPEMPVDFTGYWKMLVNENFEEYLRALDVNVALRKIANLLKPDKEIVQDGDHMIIRTLSTFRNYIMDFQVGKEFEEDLTGIDDRKCMAGVQSRDLSSL

SEQ ID NO: 819037 - protein, 180 aa, Homo sapiens
MDPPAGFVRAGNPAVAAPQSPLSPEGAHFRAAHHPRSTGSRCPGSLQPSRPLVANWLQSLPEMPVDFTGYWKMLVNENFEEYLRALDVNVALRKIANLLKPDKEIVQDGDHMIIRTLSTFRNYIMDFQVGKEFEEDLTGIDDRKCMTTVSWDGDKLQCVQKGEKEGRGWTQWIEGDELHL

SEQ ID NO: 819038 - protein, 243 aa, Homo sapiens
MDPPAGFVRAGNPAVAAPQSPLSPEGAHFRAAHHPRSTGSRCPGSLQPSRPLVANWLQSLPEMPVDFTGYWKMLVNENFEEYLRALDVNVALRKIANLLKPDKEIVQDGDHMIIRTLSTFRNYIMDFQVGKEFEEDLTGIDDRKCMTTVSWDGDKLQCVQKGEKEGRGWTQWIEGDELHLPGRFLGWVRPGPQRPWSLLRSRWTLEKGTMDGPWFCSKASLPRAWKRCLGDFKNQAMYFQGLG

SEQ ID NO: 819039 - protein, 170 aa, Homo sapiens
MGNEASYPLEMCSHFDADEIKRLGKRFKKLDLDNSGSLSVEEFMSLPELQQNPLVQRVIDIFDTDGNGEVDFKEFIEGVSQFSVKGDKEQKLRFAFRIYDMDKDGYISNGELFQVLKMMVGNNLKDTQLQQIVDKTIINADKDGDGRISFEEFCAVVGGLDIHKKMVVDV

SEQ ID NO: 819040 - protein, 170 aa, Homo sapiens; identical to SEQ ID NO: 819039

SEQ ID NO: 819041 - protein, 170 aa, Homo sapiens; identical to SEQ ID NO: 819039

SEQ ID NO: 819042 - protein, 170 aa, Homo sapiens; identical to SEQ ID NO: 819039

SEQ ID NO: 819043 - protein, 111 aa, Homo sapiens
MTNSSSAEYRPGPLVNAWTLFPLPGIAGEQLVRMQPEAEAGRSRGPRRSRRDKTCRPQLCALQWQHWVPCTATVDGYRGALPSAEWKENPWKLYPVPTISKTCSPAPGSHL

SEQ ID NO: 819044 - protein, 966 aa, Homo sapiens
AAAMWCLHCNSERTQSLLELELDSGVEGEAPSSETGTSLDSPSAYPQGPLVPGSSLSPDHYEHTSVGAYGLYSGPPGQQQRTRRPKLQHSTSILRKQAEEEAIKRSRSLSESYELSSDLQDKQVEMLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGKRGRRSSAGSLESNVEFQPFEPLQPSVLCS

SEQ ID NO: 819045 - protein, 992 aa, Homo sapiens
LQLSERAVTQCAELPRSSAACRDKSEGESSQERQLRSSLDTGSSLSTDRYSVEGEAPSSETGTSLDSPSAYPQGPLVPGSSLSPDHYEHTSVGAYGLYSGPPGQQQRTRRPKLQHSTSILRKQAEEEAIKRSRSLSESYELSSDLQDKQVEMLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGKRGRRSSAGSLESNVEFQPFEPLQPSVLCS

SEQ ID NO: 819046 - protein, 962 aa, Homo sapiens
RSQPGCGCLWQEAPTHSTGPSVEGEAPSSETGTSLDSPSAYPQGPLVPGSSLSPDHYEHTSVGAYGLYSGPPGQQQRTRRPKLQHSTSILRKQAEEEAIKRSRSLSESYELSSDLQDKQVEMLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGKRGRRSSAGSLESNVEFQPFEPLQPSVLCS

SEQ ID NO: 819047 - protein, 975 aa, Homo sapiens
LQLSERAVTQCAELPRSSAACRDKSEGESSQERSVEGEAPSSETGTSLDSPSAYPQGPLVPGSSLSPDHYEHTSVGAYGLYSGPPGQQQRTRRPKLQHSTSILRKQAEEEAIKRSRSLSESYELSSDLQDKQVEMLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGKRGRRSSAGSLESNVEFQPFEPLQPSVLCS

SEQ ID NO: 819048 - protein, 1114 aa, Homo sapiens
AAAMWCLHCNSERTQSLLELELDSGVEGEAPSSETGTSLDSPSAYPQGPLVPGSSLSPDHYEHTSVGAYGLYSGPPGQQQRTRRPKLQHSTSILRKQAEEEAIKRSRSLSESYELSSDLQDKQVEMLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGAIISSPHMRRRATSTRECPSRPHQTMPNSSSLLGSLFGSKRGKPPPQAHLPSAPALATPPPTGGPASLAALCGWPPPGAPRGAAAAAMHGHHTQYCHMQNPPPYHHHHHHHPPQHIQHAHQYHHGPHGGHPAYGAHAHGHPPLPSAHVGHTVHHHGQPPAPPPPTSSKAKPSGISTIV

SEQ ID NO: 819049 - protein, 164 aa, Homo sapiens [sequence omitted]

SEQ ID NO: 819050 - protein, 1114 aa, Homo sapiens; identical to SEQ ID NO: 819048

SEQ ID NO: 819051 - protein, 1114 aa, Homo sapiens; identical to SEQ ID NO: 819048

SEQ ID NO: 819052 - protein, 1114 aa, Homo sapiens; identical to SEQ ID NO: 819048

SEQ ID NO: 819053 - protein, 1114 aa, Homo sapiens; identical to SEQ ID NO: 819048

SEQ ID NO: 819054 - protein, 105 aa, Homo sapiens
RRPLARSCSCLVSVSFASVISLRSPYQQICKPSTLLISRESKYSNLEFSLFKNVTLTRPPVSSHWRGISLVSAQKETAWDRVIGSRLGCQGSALVSPTHQFSGLF

SEQ ID NO: 819055 - protein, 156 aa, Homo sapiens
PRLARRGRVGPGGRSFFLGRHTRAPHSAHSTDFLQASEVSFCFICKLIKSLWKIHCWVPEAGVMLPTSCLGKQKLPVSWCPRVSFMGLSPLEIPPVRATASGSCHHIPWEGRQEEAEGPRMSAWSLLTVRTPLAHLSQVTQIIAVTYRIADRSRRR

SEQ ID NO: 819056 - protein, 1114 aa, Homo sapiens; identical to SEQ ID NO: 819048

SEQ ID NO: 819057 - protein, 1209 aa, Homo sapiens
AAAMWCLHCNSERTQSLLELELDSGVEGEAPSSETGTSLDSPSAYPQGPLVPGSSLSPDHYEHTSVGAYGLYSGPPGQQQRTRRPKLQHSTSILRKQAEEEAIKRSRSLSESYELSSDLQDKQVEMLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGKSLARTTLLAQRMQDRGRASAFRACITRGRACGEASAAFPLTFRKAEQRVTYRKGAPKRHRETGPKRQKERHCTRISWGSHPHFPFLLPGVLFTCLLIWEVALARVSRRLCPVLSAAAASLCFMLMNELARNPLICLAPPCPLSPVLLSLRGLLSWETRASSSPEAIEQQPGLAPGSGKALVGTVMLWLFLCFCVCLICCQLFNPQASSTPETAYIPGSGAPGAARLRGFCQQLWPRLSLVGQERKEALADRWVPARAAAGCVAAQGVYGRVS

SEQ ID NO: 819058 - protein, 882 aa, Homo sapiens
AAAMWCLHCNSERTQSLLELELDSGVEGEAPSSETGTSLDSPSAYPQGPLVPGSSLSPDHYEHTSVGAYGLYSGPPGQQQRTRRPKLQHSTSILRKQAEEEAIKRSRSLSESYELSSDLQDKQVEMLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQCKSAPRACLEERMSQLTLFLLAASRTEPRGASTLTPVLSPESRLQLGAPVSCRHRPSRGP

SEQ ID NO: 819059 - protein, 508 aa, Homo sapiens
VQYKTSQCQYHEEELRQLLPHDTRAGWWKSGDQKENLLKRRRKKKTPKKKIKKSTHTKKPAREGGGKAGPFKKAITTTFAARMPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 819060 - protein, 426 aa, Homo sapiens
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 819061 - protein, 426 aa, Homo sapiens; identical to SEQ ID NO: 819060

SEQ ID NO: 819062 - protein, 360 aa, Homo sapiens
KSIKAILSLQAVQKQFQPMGCHLLTPIQEGLSQKTPACLKFTVHVNVGINRCACFLLCCLSSSGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 819063 - protein, 207 aa, Homo sapiens
MIQSRLVEEWGPEREFAEEEKDQKENLLKRRRKKKTPKKKIKKSTHTKKPAREGGGKAGPFKKAITTTFAARMPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGWCWHW

SEQ ID NO: 819064 - protein, 373 aa, Homo sapiens
ICARRRRTAVGGAHARRWNSPGDSRSAALASECLATGQREMWRLMSRFNAFKRTNTILHHLRMSKHTDAAEEVLLEKKGCAGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLPRLQGKLGYFLALTGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMF

SEQ ID NO: 819065 - protein, 354 aa, Homo sapiens
ICARRRRTAVGGAHARRWNSPGDSRSAALASECLATGQREMWRLMSRFNAFKRTNTILHHLRMSKHTDAAEEVLLEKKGCAGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLPRLQGKLGYFLALTGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKCLHISRDHELAQSLVNVA

SEQ ID NO: 819066 - protein, 220 aa, Homo sapiens
ICARRRRTAVGGAHARRWNSPGDSRSAALASECLATGQREMWRLMSRFNAFKRTNTILHHLRMSKHTDAAEEVLLEKKGCAGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGVVSSVHGQFYVLPASSSSSAPLYPALRPFLPLPLPFLRP

SEQ ID NO: 819067 - protein, 76 aa, Homo sapiens
SAANPTSQCQPLGGSEAAAEEEQGEGCQIREPDFFPSPGNPFRFPGSRRDICGPGTCMCVRAKERKNGSAQTHRPA

SEQ ID NO: 819068 - protein, 112 aa, Homo sapiens
ICARRRRTAVGGAHARRWNSPGDSRSAALASECLATGQREMWRLMSRFNAFKRTNTILHHLRMSKHTDAAEEVLYGVNPGGGACSEPRSRHCTPAWATERDSVSKKKKKKKR

SEQ ID NO: 819069 - protein, 421 aa, Homo sapiens
ICARRRRTAVGGAHARRWNSPGDSRSAALASECLATGQREMWRLMSRFNAFKRTNTILHHLRMSKHTDAAEEVLLEKKGCAGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLPRLQGKLGYFLALTGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAVLIDKDQSPKWKPADLKEVTEEDLNNHFKSLGSSDLKF

SEQ ID NO: 819070 - protein, 421 aa, Homo sapiens; identical to SEQ ID NO: 819069

SEQ ID NO: 819071 - protein, 421 aa, Homo sapiens; identical to SEQ ID NO: 819069

SEQ ID NO: 819072 - protein, 373 aa, Homo sapiens; identical to SEQ ID NO: 819064

SEQ ID NO: 819073 - protein, 421 aa, Homo sapiens; identical to SEQ ID NO: 819069

SEQ ID NO: 819074 - protein, 421 aa, Homo sapiens; identical to SEQ ID NO: 819069

SEQ ID NO: 819075 - protein, 435 aa, Homo sapiens
SAANPTSQCQPLGGRRRRRRRSRGRAVKFGSQIFSLLLAIPSASPAPGVTSAGRGPACVCARRSGRMAVLKLTDQRMSKHTDAAEEVLLEKKGCAGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLPRLQGKLGYFLALTGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAVLIDKDQSPKWKPADLKEVTEEDLNNHFKSLGSSDLKF

SEQ ID NO: 819076 - protein, 403 aa, Homo sapiens
ICARRRRTAVGGAHARRWNSPGDSRSAALASECLATGQREMWRLMSRFNAFKRTNTILHHLRMSKHTDAAEEVLLEKKGCAGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLPRLQGKLGYFLALTGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAGKWQMGTYHFGEMGFVSICC

SEQ ID NO: 819077 - protein, 220 aa, Homo sapiens
MPETAIGLFPDVGGGYFLPRLQGKLGYFLALTGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAVLIDKDQSPKWKPADLKEVTEEDLNNHFKSLGSSDLKF

SEQ ID NO: 819078 - protein, 163 aa, Homo sapiens
MLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAVLIDKDQSPKWKPADLKEVTEEDLNNHFKSLGSSDLKF

SEQ ID NO: 819079 - protein, 1078 aa, Homo sapiens
SAANPTSQCQPLGGRRRRRRRSRGRAVKFGSQIFSLLLAIPSASPAPGVTSAGRGPACVCARRSGRMAVLKLTDQPPLVQAIFSGDPEEIRMLIHKTEDVNTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLGQRGKISMHLTRRTGVLCTGQHTWAILDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGQKYSIVSLFSNEHVLSAGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELLLERTNSGFEESDSGATKSPLHLAAYNGHHQALEVLLQSLVDLDIRDEKGRTALDLAAFKGHTECVEALINQGASIFVKDNVTKRTPLHASVINGHTLCLRLLLEIADNPEAVDVKDAKGQTPLMLAVAYGHIDAVSLLLEKEANVDTVDILGCTALHRGIMTGHEECVQMLLEQEVSILCKDSRGRTPLHYAAARGHATWLSELLQMALSEEDCCFKDNQGYTPLHWACYNGNENCIEVLLEQKCFRKFIGNPFTPLHCAIINDHGNCASLLLGAIDSSIVSCRDDKGRTPLHAAAFADHVECLQLLLRHSAPVNAVDNSGKTALMMAAENGQAGAVDILVNSAQADLTVKDKDLNTPLHLACSKGHEKCALLILDKIQDESLINEKNNALQTPLHVAARNGLKVVVEELLAKGACVLAVDENASRSNGPRSTPGTAVQKEE

SEQ ID NO: 819080 - protein, 986 aa, Homo sapiens [sequence omitted]

SEQ ID NO: 819081 - protein, 166 aa, Homo sapiens
MLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAVLIDKDQSPKWKPADLKEVTEEDLNNHFKSLGSSDLKF

SEQ ID NO: 819082 - protein, 263 aa, Homo sapiens
ICARRRRTAVGGAHARRWNSPGDSRSAALASECLATGQREMWRLMSRFNAFKRTNTILHHLRMSKHTDAAEEVLLEKKGCAGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLPRLQGKLGYFLALTGFRLKGRDVYRAGIATHFVDSEKNGDDTIT

SEQ ID NO: 819083 - protein, 1061 aa, Homo sapiens
SAANPTSQCQPLGGRRRRRRRSRGRAVKFGSQIFSLLLAIPSASPAPGVTSAGRGPACVCARRSGRMAVLKLTDQPPLVQAIFSGDPEEIRMLIHKTEDVNTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLGQRGKISMHLTRRTGVLCTGQHTWAILDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGQKYSIVSLFSNEHVLSAGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELLLERTNSGFEESDSGATKSPLHLAAYNGHHQALEVLLQSLVDLDIRDEKGRTALDLAAFKGHTECVEALINQGASIFVKDNVTKRTPLHASVINGHTLCLRLLLEIADNPEAVDVKDAKGQTPLMLAVAYGHIDAVSLLLEKEANVDTVDILGCTALHRGIMTGHEECVQMLLEQEVSILCKDSRGRTPLHYAAARGHATWLSELLQMALSEEDCCFKDNQGYTPLHWACYNGNENCIEVLLEQKCFRKFIGNPFTPLHCAIINDHGNCASLLLGAIDSSIVSCRDDKGRTPLHAAAFADHVECLQLLLRHSAPVNAVDNSGKTALMMAAENGQAGAVDILVNSAQADLTVKDKDLNTPLHLACSKGHEKCALLILDKIQDESLINEKNNALQTPLHVAARNGLKVVVEELLAKGACVLAVDENGC

SEQ ID NO: 819084 - protein, 434 aa, Homo sapiens
SAANPTSQCQPLGGRRRRRRRSRGRAVKFGSQIFSLLLAIPSASPAPGVTSAGRGPACVCARRSGRMAVLKLTDQPPLVQAIFSGDPEEIRMLIHKTEDVNTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLGQRGKISMHLTRRTGVLCTGQHTWAILDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAK

SEQ ID NO: 819085 - protein, 243 aa, Homo sapiens
ICARRRRTAVGGAHARRWNSPGDSRSAALASECLATGQREMWRLMSRFNAFKRTNTILHHLRMSKHTDAAEEVLLEKKGCAGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGMVPLKGGGKVLLFGQRVPKGRKLRGTFPLGHKNEG

SEQ ID NO: 819086 - protein, 671 aa, Homo sapiens
SAANPTSQCQPLGGRRRRRRRSRGRAVKFGSQIFSLLLAIPSASPAPGVTSAGRGPACVCARRSGRMAVLKLTDQPPLVQAIFSGDPEEIRMLIHKTEDVNTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLGQRGKISMHLTRRTGVLCTGQHTWAILDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGQKYSIVSLFSNEHVLSAGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELLLERTNSGFEESDSGATKSPLHLAAYNGHHQAWVTE

SEQ ID NO: 819087 - protein, 1098 aa, Homo sapiens
SAANPTSQCQPLGGRRRRRRRSRGRAVKFGSQIFSLLLAIPSASPAPGVTSAGRGPACVCARRSGRMAVLKLTDQPPLVQAIFSGDPEEIRMLIHKTEDVNTLDSEKRTPLHVAAFLGDAEIIELLILSGARVNAKDNMWLTPLHRAVASRSEEAVQVLIKHSADVNARDKNWQTPLHVAAANKAVKCAEVIIPLLSSVNVSDRGGRTALHHAALNGHVEMVNLLLGQRGKISMHLTRRTGVLCTGQHTWAILDVVALLINHGAEVTCKDKKGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGQKYSIVSLFSNEHVLSAGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELLLERTNSGFEESDSGATKSPLHLAAYNGHHQALEVLLQSLVDLDIRDEKGRTALDLAAFKGHTECVEALINQGASIFVKDNVTKRTPLHASVINGHTLCLRLLLEIADNPEAVDVKDAKGQTPLMLAVAYGHIDAVSLLLEKEANVDTVDILGCTALHRGIMTGHEECVQMLLEQEVSILCKDSRGRTPLHYAAARGHATWLSELLQMALSEEDCCFKDNQGYTPLHWACYNGNENCIEVLLEQKCFRKFIGNPFTPLHCAIINDHGNCASLLLGAIDSSIVSCRDDKGRTPLHAAAFADHVECLQLLLRHSAPVNAVDNSGKTALMMAAENGQAGAVDILVNSAQADLTVKDKDLNTPLHLACSKGHEKCALLILDKIQDESLINEKNNALQTPLHVAARNGLKVVVEELLAKGACVLAVDENGHTPALACAPNKDVADCLALILATMMPFSPSSTMMAVNF

SEQ ID NO: 819088 - protein, 256 aa, Homo sapiens
ICARRRRTAVGGAHARRWNSPGDSRSAALASECLATGQREMWRLMSRFNAFKRTNTILHHLRMSKHTDAAEEVLLEKKGCAGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGVVSSVHGQFFFSSWGGYRKVSFCYARNAIGLFPELLGGWGKRGFKNFFFPFFFGGPPPKKRGGQQTRLFFSPATN

SEQ ID NO: 819089 - protein, 193 aa, Homo sapiens
ICARRRRTAVGGAHARRWNSPGDSRSAALASECLATGQREMWRLMSRFNAFKRTNTILHHLRMSKHTDAAEEVLLEKKGCAGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGKPENYIALAHHF

SEQ ID NO: 819090 - protein, 932 aa, Homo sapiens
LRPTCPLADDICDYFGVKIAMYFAWLGFYTSAMVYPAVFGSVLYTFTEADQTSRDVSCVVFALFNVIWSTLFLEEWKRRGAELAYKWGTLDSPGEAVEEPRPQFRGVRRISPITRAEEFYYPPWKRLLFQLLVSLPLCLACLVCVFLLMLGCFQLQELVLSVKGLPRLARFLPKVMLALLVSVSAEGYKKLAIWLNDMENYRLESAYEKHLIIKVVLFQFVNSYLSLFYIGFYLKDMERLKELLLVLSLSQSLERQLQAVLVPLAALRFRLLLLSLRGLLLAARAKMLATLLITRQFLQNVREVLQPHLYRRLGRGELGLRAVWELARALLGLLSLRRPAPRRLEPQADEGGGGGSGGGGRRCLSGGCGAPEEEEEAALVERRRAGEGGEEGDGPPGGKEEDEDDEEEEDEEEEEDEEEGEEGGLLDCGLRLKKVSFAERGAGRRRPGPSPEALLEEGSPTMVEKGLEPGVFTLAEEDDEAEGAPGSPEREPPAILFRRAGGEGRDQGPDGGPDPEPGSNSDSTRRQRRQNRSSWIDPPEEEHSPQLTQAELESCMKKYEDTFQDYQEMFVQFGYVVLFSSAFPLAALCALVNNLIEIRSDAFKLCTGLQRPFGQRVESIGQWQKVMEAMGVLAIVVNCYLIGQCGQLQRLFPWLSPEAAIVSVVVLEHFALLLKYLIHVAIPDIPGWVAEEMAKLEYQRREAFKRHERQAQHRYQQQQRRRREEEERQRHAEHHARREHDSGGREEARAEGSGLDPATSSEKASAKAKGSTAGGHGPERPKRPGSLLAPNNVMKLKQIIPLQGKFLSSGATSSLAAAGAGATTRPPPAQSPTGSDTRLPAFLSFKFLKSPETRRDSERSHSPPKAFHAGKLFPFGGTRAEPGSNGAGGQARPDGTPSSGSSRVQRSGPVDEALAEELEAPRPEEEGSGHKL

SEQ ID NO: 819091 - protein, 932 aa, Homo sapiens; identical to SEQ ID NO: 819090

SEQ ID NO: 819092 - protein, 932 aa, Homo sapiens; identical to SEQ ID NO: 819090

SEQ ID NO: 819093 - protein, 155 aa, Homo sapiens
KEGLARLGTGGGAGITCAPPSTVPELAARGIIQQVFPVHEQRILNRLMKSWVQAVCENQPLGAAWAGGWEGVPADRQGVTETHLPLADDICDYFGVKIAMYFAWLGFYTSAMVYPAVFGSVLYTFTEADQVLGRDPARSGGSRGALLSGLAQTMT

SEQ ID NO: 819094 - protein, 72 aa, Homo sapiens
GFRDLAGPLSLAAVAAPGLVFTALCPLLLEVHLLWPRYLQARKTGKITGSSTYWMFDKIFFLGQKHWHYWDH

SEQ ID NO: 819095 - protein, 138 aa, Homo sapiens
RLPGFGGAFVSRCSRSSRSRLHCSMSSAPRGPPSVAPLPAGIGRSTAKTPGLPGSLEMGPLTFRDVAIEFSLEEWQCLDTSQQNLYRNVMLDNYRNLVFLGIAVSKPDLITCLEQGKEPCNMKRHAMVAKPPGWSAVA

SEQ ID NO: 819096 - protein, 138 aa, Homo sapiens; identical to SEQ ID NO: 819095

SEQ ID NO: 819097 - protein, 326 aa, Homo sapiens
MLDNYRNLVFLGIAVSKPDLITCLEQGKEPCNMKRHAMVAKPPVVCSHFAQDLWPKQGLKDSFQKVILRRYGKYGHENLQLRKGCKSADEHKVHKRGYNGLNQCLTTTQSKIFQCDKYVKVLHKFSNSNIHKKRQTGKKPFKCKECGKSCCILSQLTQHKKTATRVNFYKCKTCGKAFNQFSNLTKHKIIHPEVNPYKCEECGKAFNQSLTLTKHKKIHTEEKPYKCEDCGKVFSVFSVLTKHKIIHTGTKPYNCEECGKGFSIFSTLTKHKIIHTGEKPYKCNECGKAFNWSSTLTKHKRIHTGERPYKCEECGKAFNQSSTLTR

SEQ ID NO: 819098 - protein, 588 aa, Homo sapiens
MKLEFTEKNYNSFVLQNLNRQRKRKEYWDMALSVDNHVFFAHRNVLAAVSPLVRSLISSNDMKTADELFITIDTSYLSPVTVDQLLDYFYSGKVVISEQNVEELLRGAQYFNTPRLRVHCNDFLIKSICRANCLRYLFLAELFELKEVSDVAYSGIRDNFHYWASPEGSMHFMRCPPVIFGRLLRDENLHVLNEDQALSALINWVYFRKEDREKYFKKFFNYINLNAVSNKTLVFASNKLVGMENTSSHTTLIESVLMDRKQERPCSLLVYQRKGALLDSVVILGGQKAHGQFNDGVFAYIIQENLWMKLSDMPYRAAALSATSAGRYIYISGGTTEQISGLKTAWRYDMDDNSWTKLPDLPIGLVFHTMVTCGGTVYSVGGSIAPRRYVSNIYRYDERKEVWCLAGKMSIPMDGTAVITKGDRHLYIVTGRCLVKGYISRVGVVDCFDTSTGDVVQCITFPIEFNHRPLLSFQQDNILCVHSHRQSVEINLQKVKASKTTTSVPVLPNSCPLDVSHAICSIGDSKVFVCGGVTTASDVQTKDYTINPNAFLLDQKTGKWKTLAPPPEALDCPACCLAKLPCKILQRI

SEQ ID NO: 819099 - protein, 174 aa, Homo sapiens
SEIFRNGKIESLLEASHPQEIDREFHNKLKLKEDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRKTTAFGP

SEQ ID NO: 819100 - protein, 267 aa, Homo sapiens
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAMQLWSAPDTLGEHPADDANSLKDNTTFLTQVQKAMGEKLAQLRANLPAWMTGEKCESGPWELGHGVSLTLCNLVQRYNGSRYITRVPASGRGKEDMQGGTPSEKRGDEGAQKGRHTGERRAQETARRR

SEQ ID NO: 819101 - protein, 463 aa, Homo sapiens
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQGRSSPQLDPLRKSPTMEQAVQTASAHLPAPAAVGRRSPVSTRPLPSASQKAGENQEHRRAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRKDNKVAA

SEQ ID NO: 819102 - protein, 514 aa, Homo sapiens
PNICLGRGPGVNRPRASGCCRRRRSERACGAGDSGVGSASLRAAGSGGGGAMSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQGRSSPQLDPLRKSPTMEQAVQTASAHLPAPAAVGRRSPVSTRPLPSASQKAGENQEHRRAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRKDNKVAA

SEQ ID NO: 819103 - protein, 463 aa, Homo sapiens; identical to SEQ ID NO: 819101

SEQ ID NO: 819104 - protein, 463 aa, Homo sapiens
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQGRSSPQLDPLRKSPTMEQAVQTASAHLPAPAAVGRRSPVSTRPLPSASQKAGENQEHRRAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRKTTAFGP

SEQ ID NO: 819105 - protein, 402 aa, Homo sapiens
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQGRSSPQLDPLRKSPTMEQAVQTASAHLPAPAAVGRRSPVSTRPLPSASQKAGENQEHRRAEVHKVSRPENEQLRNDNKRQVEDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRKDNKVAA

SEQ ID NO: 819106 - protein, 463 aa, Homo sapiens; identical to SEQ ID NO: 819101

SEQ ID NO: 819107 - protein, 463 aa, Homo sapiens; identical to SEQ ID NO: 819104

SEQ ID NO: 819108 - protein, 174 aa, Homo sapiens; identical to SEQ ID NO: 819099

SEQ ID NO: 819109 - protein, 463 aa, Homo sapiens; identical to SEQ ID NO: 819101

SEQ ID NO: 819110 - protein, 463 aa, Homo sapiens; identical to SEQ ID NO: 819101

SEQ ID NO: 819111 - protein, 463 aa, Homo sapiens; identical to SEQ ID NO: 819104

SEQ ID NO: 819112 - protein, 469 aa, Homo sapiens
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQGRSSPQLDPLRKSPTMEQAVQTASAHLPAPAAVGRRSPVSTRPLPSASQKAGENQEHRRAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRVSVTVNKFFGVDM

SEQ ID NO: 819113 - protein, 287 aa, Homo sapiens
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQGRSSPQLDPLRKSPTMEQAVQTASAHLPAPAAVGRRSPVSTRPLPSASQKAGENQEHRRAEVHKVSRPENEQLRNDNKRQVAPGAPSAPRRGRGGHRGGRGQFQERKL

SEQ ID NO: 819114 - protein, 504 aa, Homo sapiens
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQGRSSPQLDPLRKSPTMEQAVQTASAHLPAPAAVGRRSPVSTRPLPSASQKAGENQEHRRAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDNRRTETNPSLHAIKLFTKEPLKPATSTISLYITGPDLRRLTIGSLYLMKPSAWRIEPKRTGGNYNREGAPIHNTYAPAHIGAGAAERATRPESRGRRHSKRQERERQQDTRRHKGKQARPEPTARGH

SEQ ID NO: 819115 - protein, 287 aa, Homo sapiens; identical to SEQ ID NO: 819113

SEQ ID NO: 819116 - protein, 294 aa, Homo sapiens
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQGRSSPQLDPLRKSPTMEQAVQTASASKMLGFTGVSYCARLIILGCETRVWPSSRAAQQVRHPSRRVYVTATRGGPRKGPANLYGKAAQICGPNGGPKPKGQAPIRTQEDKHTPGR

SEQ ID NO: 819117 - protein, 318 aa, Homo sapiens
RRNARPAAAARGAGFQAPGGCLRPSARPGALESPSLGPRKVPGRARGSMMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVISAETELQRAAMDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQEAGWAATCQTLI

SEQ ID NO: 819118 - protein, 336 aa, Homo sapiens
RRNARPAAAARGAGFQAPGGCLRPSARPGALESPSLGPRKVPGRARGSMMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVISAETELQRAAMDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQVSTCRLRKDQQAEDDEDDELDVTEEENFLK

SEQ ID NO: 819119 - protein, 316 aa, Homo sapiens
RRNARPAAAARGAGFQAPGGCLRPSARPGALESPSLGPRKVPGRARGSMMRRTLENRNAQTKQLQTAVSNVEKHFGELCQIFAAYVRKTARLRDKADLLVNEINAYAATETPHLKLGLMNFADEFAKLQDYRQAEVERLEAKVVEPLKTYGTIVKMKRDDLKATLTARNREAKQLTQLERTRQRNPSDRHVISAETELQRAAMDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQVSKKPYSKGI

SEQ ID NO: 819120 - protein, 318 aa, Homo sapiens; identical to SEQ ID NO: 819117

SEQ ID NO: 819121 - protein, 336 aa, Homo sapiens; identical to SEQ ID NO: 819118

SEQ ID NO: 819122 - protein, 127 aa, Homo sapiens
MLFQAETELQRAAMDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQVSKKPYSKGI

SEQ ID NO: 819123 - protein, 147 aa, Homo sapiens
MGPLRRIPTLSGRLHGPRCDLGPNSLGCSHRRRRRGARGPAGCHPPTPPGLGSPHCRGQCGSLGGSRAPRPRCAEQPEQPPPQLRPGPPGLGLFLCLHSPDSEERSNETTANSCLKCGEAFWRTVPNLRCLCAENCQAERQSRPPGE

SEQ ID NO: 819124 - protein, 134 aa, Homo sapiens
MDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQVSTCRLRKDQQAEDDEDDELDVTEEENFLK

SEQ ID NO: 819125 - protein, 180 aa, Homo sapiens
RRNARPAAAARGAGFQAPGGCLRPSARPGALESPSLGPRKVPGRARGSMMRRTLENRNAQTKQLQTAVSNVEKHFGELCQIFAAYVRKTARLRDKADLLVNEINAYAATETPHLKLGLMNFADEFAKLQDYRQAENLKREFQFSKNRMSIKKIELIIAIHTNLKSNHIWRYFWKNVEFLS

SEQ ID NO: 819126 - protein, 336 aa, Homo sapiens; identical to SEQ ID NO: 819118

SEQ ID NO: 819127 - protein, 336 aa, Homo sapiens; identical to SEQ ID NO: 819118

SEQ ID NO: 819128 - protein, 166 aa, Homo sapiens
MAQTNSFFMLISSLMFLSLSQGQESQTELPNPRISCPEGTNAYRSYCYYFNEDPETWVDADLYCQNMNSGNLVSVLTQAEGAFVASLIKESSTDDSNVWIGLHDPKKNRRWHWSSGSLVSYKSWDTGSPSSANAGYCASLTSCSGFKKWKDESCEKKFSFVCKFKN

SEQ ID NO: 819129 - protein, 198 aa, Homo sapiens
MAQTNSFFMLISSLMFLSLSQGQESQTELPNPRISCPEGTNAYRSYCYYFNEDPETWVDADLYCQNMNSGNLVSVLTQAEGAFVASLIKESSTDDSNVWIGLHDPKKNRRWHWSSGSLVSYKSWDTGSPSSANAGYCASLTSCSGERQTIYPPVAISFPLISGDEHGDWDRGKDSRNGRMNLVRRSSPLFASSKTRGS

SEQ ID NO: 819130 - protein, 166 aa, Homo sapiens; identical to SEQ ID NO: 819128

SEQ ID NO: 819131 - protein, 198 aa, Homo sapiens; identical to SEQ ID NO: 819129

SEQ ID NO: 819132 - protein, 67 aa, Homo sapiens
MAQTNSFFMLISSLMFLSLSQGQESQTELPNPRISCPEGTNAYRSYCYYFKKEETPLGETPPGVFLY

SEQ ID NO: 819133 - protein, 563 aa, Homo sapiens
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 819134 - protein, 563 aa, Homo sapiens; identical to SEQ ID NO: 819133

SEQ ID NO: 819135 - protein, 563 aa, Homo sapiens; identical to SEQ ID NO: 819133

SEQ ID NO: 819136 - protein, 563 aa, Homo sapiens; identical to SEQ ID NO: 819133

SEQ ID NO: 819137 - protein, 320 aa, Homo sapiens
MRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 819138 - protein, 563 aa, Homo sapiens; identical to SEQ ID NO: 819133

SEQ ID NO: 819139 - protein, 247 aa, Homo sapiens
CSVEKSVHSHLGPCLEGSKSLSQSHIHASPQSLVPPARPGLYSPLPTYLGGPLGSPTIQMLSSPLSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 819140 - protein, 563 aa, Homo sapiens; identical to SEQ ID NO: 819133

SEQ ID NO: 819141 - protein, 563 aa, Homo sapiens; identical to SEQ ID NO: 819133

SEQ ID NO: 819142 - protein, 563 aa, Homo sapiens; identical to SEQ ID NO: 819133

SEQ ID NO: 819143 - protein, 563 aa, Homo sapiens; identical to SEQ ID NO: 819133

SEQ ID NO: 819144 - protein, 563 aa, Homo sapiens; identical to SEQ ID NO: 819133

SEQ ID NO: 819145 - protein, 563 aa, Homo sapiens; identical to SEQ ID NO: 819133

SEQ ID NO: 819146 - protein, 563 aa, Homo sapiens; identical to SEQ ID NO: 819133

SEQ ID NO: 819147 - protein, 484 aa, Homo sapiens
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSVRISPSPNS

SEQ ID NO: 819148 - protein, 489 aa, Homo sapiens
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYIAVITQDFLTCWLSIRQAELLLPGAEFHHYVGDLRNPVWR

SEQ ID NO: 819149 - protein, 321 aa, Homo sapiens
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGTTKRTGQWGRGWEMGVDPCSLKGML

SEQ ID NO: 819150 - protein, 138 aa, Homo sapiens
MGLQACLLGLFALILSGKCSYSPEPDQRRTLPPGWVSLGRADPEEELSLTFALRQQNVERLSELVQAVSDPSSPQYGKYLTLENVADLVRPSPLDEGTCPHPVGGLRLIGVAIKGQHNNGNCGNINVQPDCIVSISWF

SEQ ID NO: 819151 - protein, 185 aa, Homo sapiens
RFPPTSSLRQRPEPQVTGTVGLHLGVTPSVIRKRYNLTSQDVGSGTSNNSQACAQVSQAKSPRVLIASPQCPQFLTTLGLTLGPTISALTPSIFLEQYFHDSDLAQFMRLFGGNFAHQASVARVVGQQGRGRAGIEASLDVQYLMSAGANISTWVYSSPGTTKRTGQWGRGWEMGVDPCSLKGML

SEQ ID NO: 819152 - protein, 127 aa, Homo sapiens
MCPLPLAAAAVAAPRAPLRLLNRGLAAAMSTAQSLKSVDYEVFGRVQGVCFRMYTEDEARKIGVVGWVKNTSKGTVTGQVQGPEDKVNSMKSWLSKVGSPSSRIDRTNFSNEKTISKLEYSNFSIRY

SEQ ID NO: 819153 - protein, 127 aa, Homo sapiens; identical to SEQ ID NO: 819152

SEQ ID NO: 819154 - protein, 88 aa, Homo sapiens
AERRRRGRRWWRQLEPNGLRLLRRGPGSEPPPQASPAQREAASPETRGRIPSYCPASPGVAHSKRQPTGVPVATTGGSQTQPACTQVK

SEQ ID NO: 819155 - protein, 64 aa, Homo sapiens
MSTAQSLKSVDYEVFGRVQGRRPLYGGRSKRLWEEGEKAVRSASHLKYAFSRCGWDFRSAMTQQ

SEQ ID NO: 819156 - protein, 88 aa, Homo sapiens; identical to SEQ ID NO: 819154

SEQ ID NO: 819157 - protein, 129 aa, Homo sapiens
MCPLPLAAAAVAAPRAPLRLLNRGLAAAMSTAQSLKSVDYEVFGRVQGVCFRMYTEDEARKIGVVGWVKNTSKGTVTGQVQGPEDKVNSILDFTLLASLVLNPWPQVIRLPWPPKVLGLQWCLQILSLL

SEQ ID NO: 819158 - protein, 175 aa, Homo sapiens
MLLTQSLFGGLFPRTRETMRRYKVSLFYLGCSRTPNVKLSSCLGLPCCWDYSYKFIQLSEFGFGQVIIVSEEPWKENISCSSTTFIKSTICLSGVCFRMYTEDEARKIGVVGWVKNTSKGTVTGQVQGPEDKVNSILDFTLLASLVLNPWPQVIRLPWPPKVLGLQWCLQILSLL

SEQ ID NO: 819159 - protein, 122 aa, Homo sapiens
MCPLPLAAAAVAAPRAPLRLLNRGLAAAMSTAQSLKSVDYEVFGRVQGVCFRMYTEDEARKIGVVGWVKNTSKGTVTGQVQGPEDKVNSILLFPSIEALIAQIPNNFGVMPLPSSWSVRSPG

SEQ ID NO: 819160 - protein, 125 aa, Homo sapiens
MCPLPLAAAAVAAPRAPLRLLNRGLAAAMSTAQSLKSVDYEVFGRVQGVCFRMYTEDEARKIGVVGWVKNTSKGTVTGQVQGPEDKVNSMLECSGTISAHYNLCLPGSDLPDSASQVAGTTGSPG

SEQ ID NO: 819161 - protein, 129 aa, Homo sapiens; identical to SEQ ID NO: 819157

SEQ ID NO: 819162 - protein, 142 aa, Homo sapiens
MLLTQSLFGGLFPRTRETMRSYKFIQLSEFGFGQVIIVSEEPWKENISCSSTTFIKSTICLSGVCFRMYTEDEARKIGVVGWVKNTSKGTVTGQVQGPEDKVNSMKSWLSKVGSPSSRIDRTNFSNEKTISKLEYSNFSIRY

SEQ ID NO: 819163 - protein, 127 aa, Homo sapiens; identical to SEQ ID NO: 819152

SEQ ID NO: 819164 - protein, 127 aa, Homo sapiens; identical to SEQ ID NO: 819152

SEQ ID NO: 819165 - protein, 127 aa, Homo sapiens; identical to SEQ ID NO: 819152

SEQ ID NO: 819166 - protein, 122 aa, Homo sapiens; identical to SEQ ID NO: 819159

SEQ ID NO: 819167 - protein, 129 aa, Homo sapiens; identical to SEQ ID NO: 819157

SEQ ID NO: 819168 - protein, 129 aa, Homo sapiens; identical to SEQ ID NO: 819157

SEQ ID NO: 819169 - protein, 122 aa, Homo sapiens; identical to SEQ ID NO: 819159

SEQ ID NO: 819170 - protein, 122 aa, Homo sapiens; identical to SEQ ID NO: 819159

SEQ ID NO: 819171 - protein, 129 aa, Homo sapiens; identical to SEQ ID NO: 819157

SEQ ID NO: 819172 - protein, 88 aa, Homo sapiens; identical to SEQ ID NO: 819154

SEQ ID NO: 819173 - protein, 219 aa, Homo sapiens
PLPGVNSALTPPPALRPASMDLLRPHWLEVSRDITGPQAAPSAFPHQELPRALPAAAATAGCAGLEATYSNVGLAALPGVSLAASPVVAEYARVQKRKGTHRSPQEPQQGKTEVTPAAQVDVLYSRVCKPKRRDPGPTTDPLDPKGQGAILALAGDLAYQTLPLRALDVDSGPLENVYESIRELGDPAGRSSTCGAGTPPASSCPSLGRGWRPLPASLP

SEQ ID NO: 819174 - protein, 252 aa, Homo sapiens
SVRAGEALTASRRWRRAGAGEGCGGGATVQQAVGTAMHSAWCHMPTAASVTRARSPRGGVSWLCPGSELIGQSPGHHAQILWPGWATALCPSLAVVGSDAVDSAQSSALCPSLAVVGSDAVDSGTCSSAFAGWEVHTRGIGSRLLTKMGYEFGKARVSTSCPGEVGRLLQHSPGPAAIRFPGSRSHRVPRVPQTQHCHPRAPQIPGVPRPQHCHPRAPQIPRVLRPQHCHLRAPQIPGVPWPQHCHPRAPQI

SEQ ID NO: 819175 - protein, 548 aa, Homo sapiens
STSGSGGAREEVPIGCWGEKGAPGRSSRPGPAPPSLSMDEESLESALQTYRAQLQQVELALGAGLDSSEQADLRQLQGDLKELIELTEASLVSVRKSSLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 819176 - protein, 571 aa, Homo sapiens
ALPEAAALGRKCRSAAGAKRGRRAALAGEAGGLSVAAAGKPRGGGARPGTSPGPAPPSLSMDEESLESALQTYRAQLQQVELALGAGLDSSEQADLRQLQGDLKELIELTEASLVSVRKSSLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 819177 - protein, 511 aa, Homo sapiens
MDEESLESALQTYRAQLQQVELALGAGLDSSEQADLRQLQGDLKELIELTEASLVSVRKSSLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 819178 - protein, 548 aa, Homo sapiens; identical to SEQ ID NO: 819175

SEQ ID NO: 819179 - protein, 405 aa, Homo sapiens
KPHPPQPPQHSSEAGVNLDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 819180 - protein, 361 aa, Homo sapiens
MVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 819181 - protein, 548 aa, Homo sapiens; identical to SEQ ID NO: 819175

SEQ ID NO: 819182 - protein, 548 aa, Homo sapiens; identical to SEQ ID NO: 819175

SEQ ID NO: 819183 - protein, 548 aa, Homo sapiens; identical to SEQ ID NO: 819175

SEQ ID NO: 819184 - protein, 548 aa, Homo sapiens; identical to SEQ ID NO: 819175

SEQ ID NO: 819185 - protein, 568 aa, Homo sapiens
STSGSGGAREEVPIGCWGEKGAPGRSSRPGPAPPSLSMDEESLESALQTYRAQLQQVELALGAGLDSSEQADLRQLQGDLKELIELTEASLVSVRKSSLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSAQSSALCPSLAVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 819186 - protein, 295 aa, Homo sapiens
MGLPVSWAPPALWVLGCCALLLSLWALCTACRRPEDAVAPRKRARRQRARLQGSATAAEASLLRRTHLCSLSKSDTRLHELHRGPRSSRALRPASMDLLRPHWLEVSRDITGPQAAPSAFPHQELPRALPAAAATAGCAGLEATYSNVGLAALPGVSLAASPVVAEYARVQKRKGTHRSPQEPQQGKTEVTPAAQVDVLYSRVCKPKRRDPGPTTDPLDPKGQGAILALAGDLAYQTLPLRALDVDSGPLENVYESIRELGDPAGRSSTCGAGTPPASSCPSLGRGWRPLPASLP

SEQ ID NO: 819187 - protein, 548 aa, Homo sapiens; identical to SEQ ID NO: 819175

SEQ ID NO: 819188 - protein, 337 aa, Homo sapiens
MFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSAQSSALCPSLAVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 819189 - protein, 295 aa, Homo sapiens; identical to SEQ ID NO: 819186

SEQ ID NO: 819190 - protein, 548 aa, Homo sapiens; identical to SEQ ID NO: 819175

SEQ ID NO: 819191 - protein, 548 aa, Homo sapiens; identical to SEQ ID NO: 819175

SEQ ID NO: 819192 - protein, 548 aa, Homo sapiens; identical to SEQ ID NO: 819175

SEQ ID NO: 819193 - protein, 454 aa, Homo sapiens
STSGSGGAREEVPIGCWGEKGAPGRSSRPGPAPPSLSMDEESLESALQTYRAQLQQVELALGAGLDSSEQADLRQLQGDLKELIELTEASLVSVRKSSLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNENRPAAGAEEGRHPQEDD

SEQ ID NO: 819194 - protein, 347 aa, Homo sapiens
STSGSGGAREEVPIGCWGEKGAPGRSSRPGPAPPSLSMDEESLESALQTYRAQLQQVELALGAGLDSSEQADLRQLQGDLKELIELTEASLVSVRKSSLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDSVALVGGYQLDSYMF

SEQ ID NO: 819195 - protein, 81 aa, Homo sapiens
FPHQELPRALPAAAATAGCAGLEATYSNVGLAALPGVSLAASPVVAEYARVQKRKGTHRSPQEPQQGKTEVTPAAQVTWAR

SEQ ID NO: 819196 - protein, 1310 aa, Homo sapiens
PWRRQRRRERRARGRARPGPEEATRPWCTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 819197 - protein, 1041 aa, Homo sapiens
GAGMDGPGASAVVVRVGIPDLQQTKCLRLDPAAPVWAAKQRVALALNHSLQDALNYGLFQPPSRGRAGKFLDEERLLQEYPPNLDTPLPYLEFRYKRRVYAQNLIDDKQFESFTQRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 819198 - protein, 730 aa, Homo sapiens
GGPELTAAPFPHSPGRCLLPRPKSLAGSCPSTRLLTLEEAQARTQAGWGRPRSPQLPRPRPHLRKGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 819199 - protein, 1310 aa, Homo sapiens; identical to SEQ ID NO: 819196

SEQ ID NO: 819200 - protein, 1238 aa, Homo sapiens
PWRRQRRRERRARGRARPGPEEATRPWCTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLHLASLGTDTMRPDASVSPRKSADYTRRHTDSTVSRHHLDSRSDHIAHCDRFSPHSELALMRASHPREAYHHHILMPTTKHEHRLISSTTTSKDKLTEPEDPPSKQQKTRSRTRPPLNLVTAQRRTHQPRTDQPARTRTRRPTDPPPHPQRPRHPGPQSPAPPHPRTGRPAGRPAATAQPQRRNPSPQTTHDPRRQASTSTHSPRPQATAPGARPHERRARGAEHESRAADSRKDADTTQRHAQRAPTTERKPRRHNEQKDYKDNKGTYIYSTQTDRNYNIKKNTDEQTPTYQQTEQKLEITTTATDTQHASSNKENRINTNRTDKQKAWIKSKNIKRRAN

SEQ ID NO: 819201 - protein, 597 aa, Homo sapiens
PWRRQRRRERRARGRARPGPEEATRPWCTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAER

SEQ ID NO: 819202 - protein, 246 aa, Homo sapiens
MLSLSLCSHLWGPLILSALQARSTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMEVGLGRGLGDSEWVRGCVCHHAQHREILDGNRVASAVEDEGAEVDGEAFRWGSLWVGESWDM

SEQ ID NO: 819203 - protein, 1300 aa, Homo sapiens
IEVAEALNGPEALNGPGGTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 819204 - protein, 1282 aa, Homo sapiens
PWRRQRRRERRARGRARPGPEEATRPWCTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 819205 - protein, 1047 aa, Homo sapiens
PWRRQRRRERRARGRARPGPEEATRPWCTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQQEPPACPDLCTGMGGQLLPFFPHMPH

SEQ ID NO: 819206 - protein, 561 aa, Homo sapiens
PWRRQRRRERRARGRARPGPEEATRPWCTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAAPPLRIPTSWPGRRSS

SEQ ID NO: 819207 - protein, 461 aa, Homo sapiens
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 819208 - protein, 313 aa, Homo sapiens
TRLGRGRGNSAEGIRRNPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRTKQMRKYYFIPAYVGTHHVDGGSNRIVEARGLAVKRLVGHGCSLEKWGVNRGGRPEQGSKTRSPM

SEQ ID NO: 819209 - protein, 461 aa, Homo sapiens; identical to SEQ ID NO: 819207

SEQ ID NO: 819210 - protein, 461 aa, Homo sapiens; identical to SEQ ID NO: 819207

SEQ ID NO: 819211 - protein, 461 aa, Homo sapiens; identical to SEQ ID NO: 819207

SEQ ID NO: 819212 - protein, 461 aa, Homo sapiens; identical to SEQ ID NO: 819207

SEQ ID NO: 819213 - protein, 461 aa, Homo sapiens; identical to SEQ ID NO: 819207

SEQ ID NO: 819214 - protein, 461 aa, Homo sapiens; identical to SEQ ID NO: 819207

SEQ ID NO: 819215 - protein, 461 aa, Homo sapiens; identical to SEQ ID NO: 819207

SEQ ID NO: 819216 - protein, 461 aa, Homo sapiens; identical to SEQ ID NO: 819207

SEQ ID NO: 819217 - protein, 461 aa, Homo sapiens; identical to SEQ ID NO: 819207

SEQ ID NO: 819218 - protein, 473 aa, Homo sapiens
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKRYLHNGGGTTGRLLEIGKPGEKDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 819219 - protein, 428 aa, Homo sapiens
SEQYEAGGESAEAHILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 819220 - protein, 332 aa, Homo sapiens
MMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 819221 - protein, 461 aa, Homo sapiens; identical to SEQ ID NO: 819207

SEQ ID NO: 819222 - protein, 363 aa, Homo sapiens
GRSRRGGVIGTRANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 819223 - protein, 355 aa, Homo sapiens
SEQYEAGGESAEAIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 819224 - protein, 414 aa, Homo sapiens [sequence omitted]

SEQ ID NO: 819225 - protein, 340 aa, Homo sapiens
MKSLTATSSMKVLLPRTFWTRKLMKFLLLLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 819226 - protein, 241 aa, Homo sapiens
MGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 819227 - protein, 366 aa, Homo sapiens
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDGDEKESGGFVLEEGHGTNGHLDRISLWKEPKSFPLGRFPQLGGAGWAKRGRLQHNMGGTPTP

SEQ ID NO: 819228 - protein, 328 aa, Homo sapiens
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDGSSGQHNSRGPPFFNAEKGKDTTG

SEQ ID NO: 819229 - protein, 303 aa, Homo sapiens
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKWFTDDGCSK

SEQ ID NO: 819230 - protein, 174 aa, Homo sapiens
ILYDHAHNTIKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 819231 - protein, 180 aa, Homo sapiens
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKGLRIGTEDSKPAVAQVKWWPSEPEGLWRES

SEQ ID NO: 819232 - protein, 199 aa, Homo sapiens
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKFGDWPEDSKSVVWVNGGGETRPWKGESNTVWAAVKGRGRRIGGVMGRAF

SEQ ID NO: 819233 - protein, 106 aa, Homo sapiens
VSDSSRPQKRCIKWAWYSPRGRYKLCFLGNKCSLKANGAGGYMTTSHAFLFIPRVKPHMDSMTPLFFFRLKYSWCRVWGCLQRGLSMQILVNKYLKLSMLLIMESR

SEQ ID NO: 819234 - protein, 403 aa, Homo sapiens
LGSGSGAPQSCRPLDRARRSGESGATRRAVARMEEAGAAVVTAGEAELNWSRLSVSTETLESELEARGEERRGAREALLRLLLPHNRLVSLPRALGSGFPHLQLLDVSGNALTALGPELLALRGLRTLLAKNNRLGGPSALPKGLAQSPLCRSLQVLNLSGNCFQEVPASLLELRALQTLSLGGNQLQSIPAEIENLQSLECLYLGGNFIKEIPPELGNLPSLNYLVLCDNKIQSIPPQLSQLHSLRSLSLHNNLLTYLPREILNLIHLEELSLRGNPLVVRFVRDLTYDPPTLLELAARTIKIRNISYTPYDLPGNLLRYLGSASNCPNPKCGGVYFDCCVRQIKFVDFCGKYRLPLMHYLCSPECSSPCSSASHSSTSQSESDSEDEASVAARRMQKVLLG

SEQ ID NO: 819235 - protein, 403 aa, Homo sapiens; identical to SEQ ID NO: 819234

SEQ ID NO: 819236 - protein, 368 aa, Homo sapiens
MRVAGREGRFLSAGVAAREGSAMFLSILVALCLWLHLALGVRGAPCEAVRIPMCRHMPWNITRMPNHLHHSTQENAILAIEQYEELVDVNCSAVLRFFLCAMYAPICTLEFLHDPIKPCKSVCQRARDDCEPLMKMYNHSWPESLACDELPVYDRGVCISPEAIVTDLPEDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENCLVEKWRDQLSKRSIQWEERLQEQRRTVQDKKKTAGRTSRSNPPKPKGKPPAPKPASPKKNIKTRSAQKRTNPKRV

SEQ ID NO: 819237 - protein, 368 aa, Homo sapiens; identical to SEQ ID NO: 819236

SEQ ID NO: 819238 - protein, 629 aa, Homo sapiens
WGGDGLELRAVCEAHAQEPALCVPHPSSRAMSRSLLLRFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 819239 - protein, 629 aa, Homo sapiens; identical to SEQ ID NO: 819238

SEQ ID NO: 819240 - protein, 629 aa, Homo sapiens; identical to SEQ ID NO: 819238

SEQ ID NO: 819241 - protein, 592 aa, Homo sapiens
WGGDGLELRAVCEAHAQEPALCVPHPSSRAMSRSLLLRFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 819242 - protein, 629 aa, Homo sapiens; identical to SEQ ID NO: 819238

SEQ ID NO: 819243 - protein, 581 aa, Homo sapiens
WGGDGLELRAVCEAHAQEPALCVPHPSSRAMSRSLLLRFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 819244 - protein, 526 aa, Homo sapiens
WGGDGLELRAVCEAHAQEPALCVPHPSSRAMSRSLLLRFLLFLLLLPPLPVLLADPGAPTPAGLWTWLRNSLRPSPSFTHFLLTHGRWFWEFVNATFIREMLMRLVLTVRSNLIPSPPTYNSAHDYISWESFSNFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 819245 - protein, 490 aa, Homo sapiens
MLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 819246 - protein, 629 aa, Homo sapiens; identical to SEQ ID NO: 819238

SEQ ID NO: 819247 - protein, 629 aa, Homo sapiens; identical to SEQ ID NO: 819238

SEQ ID NO: 819248 - protein, 629 aa, Homo sapiens; identical to SEQ ID NO: 819238

SEQ ID NO: 819249 - protein, 629 aa, Homo sapiens; identical to SEQ ID NO: 819238

SEQ ID NO: 819250 - protein, 629 aa, Homo sapiens; identical to SEQ ID NO: 819238

SEQ ID NO: 819251 - protein, 105 aa, Homo sapiens
GRLLLLNSRPRRRQLPAPSCFTKGEVPGHLRVSLCGAQNLQGPLSMPLVPWTVSLVHLLSPSILSQSTDFSHSAVSVQPYPRDLDAWPPNLALGYPDANQTPPSS

SEQ ID NO: 819252 - protein, 112 aa, Homo sapiens
RGLTLFARAPIFADLCSGYNLPPGNTYDLDSAKPLIRPTYGKSCSACRYGSEFRGRLLLLNSRPRRRKFMLCAGRWTGGKSTCSWVILITELTMPALPMVLHGSLVPWRGGV

SEQ ID NO: 819253 - protein, 275 aa, Homo sapiens
EPQAYHLHPESCVTMWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 819254 - protein, 159 aa, Homo sapiens
MSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 819255 - protein, 107 aa, Homo sapiens
GIEGLTNFSWGHHANANPIYKVPLLGHVAQSARFYQAGWGGKPCEEQQSWRYCQQRTLRRRMTSDCFFLHSSWMYLYAPILAYLMAAASCRIRHEGWGVCVICGVQR

SEQ ID NO: 819256 - protein, 76 aa, Homo sapiens
RGLTLFARAPIFADLCSGYNLPPGNTYDLDSAKPLIRPTYGKSCSACRYGSEFRGRLLLLNSRPRRRMCWTLSMKH

SEQ ID NO: 819257 - protein, 70 aa, Homo sapiens
TRCEGDSEQDLKSVILLGRHSLFHPEDTGQVFQVSHSFPHPLYDMSLLKNRFKQGLWEVGFVVTRGQGEL

SEQ ID NO: 819258 - protein, 261 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 819259 - protein, 261 aa, Homo sapiens; identical to SEQ ID NO: 819258

SEQ ID NO: 819260 - protein, 261 aa, Homo sapiens; identical to SEQ ID NO: 819258

SEQ ID NO: 819261 - protein, 238 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSWVILITELTMPALPMVLHGSLVPWRGGV

SEQ ID NO: 819262 - protein, 306 aa, Homo sapiens
MSVSLCFCLFFLILCIFGSPCLSLFSPLPFHSLCPFTLFLFPLVSLSFCICPSPSHTAVSQLVVCIFGLNCVFPNPVFFSLFLFLFWSLLLAPLSLLSFLIILAPHSCVCFLPSKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 819263 - protein, 244 aa, Homo sapiens
RAPSLPPAPGELCHHVGPGCLPHPVRDVDWAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 819264 - protein, 261 aa, Homo sapiens; identical to SEQ ID NO: 819258

SEQ ID NO: 819265 - protein, 234 aa, Homo sapiens
RAPSLPPAPGELCHHVGPGCLPHPVRDVDWCCTPHPVSDCGRLGVREAFPTLAGACGLSWQGSLRRCSGAPPVGPHSCPLHQELRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 819266 - protein, 261 aa, Homo sapiens; identical to SEQ ID NO: 819258

SEQ ID NO: 819267 - protein, 323 aa, Homo sapiens
EPQAYHLHPESCVTMWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEELYRLGQMVQPGAQMPGSEGGGDRTPGSEGGGPRNQVGSSPQQCFCLARILTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 819268 - protein, 84 aa, Homo sapiens
ELGTQTTRRPESCVTMWVPVVFLTLSVTWIGAAPLILSRIVGGWECEKHSQPWQVLVASRGRAVCGGVLVHPQWVLTAAHCIRK

SEQ ID NO: 819269 - protein, 137 aa, Homo sapiens
EPQAYHLHPESCVTMWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMS

SEQ ID NO: 819270 - protein, 193 aa, Homo sapiens
EPQAYHLHPESCVTMWVPVVFLTLSVTWIGAAPLILSRIVGGWECEKHSQPWQVLVASRGRAVCGGVLVHPQWVLTAAHCIRNKSVICWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 819271 - protein, 109 aa, Homo sapiens
ARTRGRSVEPDEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 819272 - protein, 195 aa, Homo sapiens
RSTTTTKFAAASTSWKVASVRSHGDSILQMVLALVPPTCLQGLSSWTLPSAQELDPEVPSPPARTGAPTPLLESLPTFFWKSALETFLSSSKAGNCYLLSACPGLKDRIAQAETGTDLSHSLPAFTLRVILGAHLSVMVCFKVSRHGAVNHVPCPKGLPCTPRWCITGSGSRTPSWPTPEHPYQLPIVVNLEPWK

SEQ ID NO: 819273 - protein, 134 aa, Homo sapiens
RGLTLFARAPIFADLCSGYNLPPGNTYDLDSAKPLIRPTYGKSCSACRYGSEFRGRLLLLNSRPRRRVILGAHLSVMVCFKVSRHGAVNHVPCPKGLPCTPRWCITGSGSRTPSWPTPEHPYQLPIVVNLEPWK

SEQ ID NO: 819274 - protein, 141 aa, Homo sapiens
GLNCCPSARNAPYFPCDKASKEEERPSSEDEIALHFEPPNAPLNRKGLVSPQSPQKSDCQPNSPTESCSSKNACILQKMGQWTGGKSTCSGDSGGPLVCNGVLQGITSWGSEPCALPERPSLYTKVVHYRKWIKDTIVANP

SEQ ID NO: 819275 - protein, 86 aa, Homo sapiens
RGLTLFARAPIFADLCSGYNLPPGNTYDLDSAKPLIRPTYGKSCSACRYGSEFRGRLLLLNSRPRRRLSLGVRSRVARKRNQQTQV

SEQ ID NO: 819276 - protein, 71 aa, Homo sapiens
RGLTLFARAPIFADLCSGYNLPPGNTYDLDSAKPLIRPTYGKSCSACRYGSEFRGRLLLLNSRPRRRQSVS

SEQ ID NO: 819277 - protein, 80 aa, Homo sapiens
RGLTLFARAPIFADLCSGYNLPPGNTYDLDSAKPLIRPTYGKSCSACRYGSEFRGRLLLLNSRPRRRMGCLCYLWGTEMR

SEQ ID NO: 819278 - protein, 88 aa, Homo sapiens
RGLTLFARAPIFADLCSGYNLPPGNTYDLDSAKPLIRPTYGKSCSACRYGSEFRGRLLLLNSRPRRRDERGVGSTLREWRVTCAGHCP

SEQ ID NO: 819279 - protein, 261 aa, Homo sapiens; identical to SEQ ID NO: 819258

SEQ ID NO: 819280 - protein, 261 aa, Homo sapiens; identical to SEQ ID NO: 819258

SEQ ID NO: 819281 - protein, 261 aa, Homo sapiens; identical to SEQ ID NO: 819258

SEQ ID NO: 819282 - protein, 251 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKFTTIGS

SEQ ID NO: 819283 - protein, 238 aa, Homo sapiens; identical to SEQ ID NO: 819261

SEQ ID NO: 819284 - protein, 228 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGTASVFVDAAANLVVVVD

SEQ ID NO: 819285 - protein, 230 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSVILGAHLSVQWLRWPSEPPE

SEQ ID NO: 819286 - protein, 213 aa, Homo sapiens [sequence omitted]

SEQ ID NO: 819287 - protein, 76 aa, Homo sapiens; identical to SEQ ID NO: 819256

SEQ ID NO: 819288 - protein, 73 aa, Homo sapiens
RSTTTTKFAAASTHVLDTVHEALSRSWRHNAPDTHSKDGAENITHSVLEALGSLEKAVSQGGRVFLWHGMGMK

SEQ ID NO: 819289 - protein, 168 aa, Homo sapiens
MVGGMQEREPALTVKLRLFPPQPSTPAQTGSWALFCLSQPHSKPIPPAPPYCNSPHSHTRSPLPPTYPRTFSPLPSQLPAPSCFTKGEVPGHLRVSLCGAQNLQGPLSMPLVPWTVSLVHLLSPSILSQSTDFSHSAVSVQPYPRDLDAWPPNLALGYPDANQTPPSS

SEQ ID NO: 819290 - protein, 84 aa, Homo sapiens; identical to SEQ ID NO: 819268

SEQ ID NO: 819291 - protein, 84 aa, Homo sapiens; identical to SEQ ID NO: 819268

SEQ ID NO: 819292 - protein, 84 aa, Homo sapiens; identical to SEQ ID NO: 819268

SEQ ID NO: 819293 - protein, 202 aa, Homo sapiens
EPQAYHLHPESCVTMWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFSVTPVVLSCSKYDHATALQLGNR

SEQ ID NO: 819294 - protein, 125 aa, Homo sapiens
MVLALVPPTCLQGLSSWTLPSAQELDPEVPSPPARTGAPTPLLESLPTFFWKSALETFLSSSKAGNCYLLSACPGLKDRIAQAETGTDLSHSLPAFTLRVILGAHLSVMVCFKVSRHGAVNHVPC

SEQ ID NO: 819295 - protein, 259 aa, Homo sapiens
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQMYFNVQN

SEQ ID NO: 819296 - protein, 259 aa, Homo sapiens; identical to SEQ ID NO: 819295

SEQ ID NO: 819297 - protein, 259 aa, Homo sapiens; identical to SEQ ID NO: 819295

SEQ ID NO: 819298 - protein, 119 aa, Homo sapiens
MAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQMYFNVQN

SEQ ID NO: 819299 - protein, 119 aa, Homo sapiens; identical to SEQ ID NO: 819298

SEQ ID NO: 819300 - protein, 119 aa, Homo sapiens; identical to SEQ ID NO: 819298

SEQ ID NO: 819301 - protein, 259 aa, Homo sapiens; identical to SEQ ID NO: 819295

SEQ ID NO: 819302 - protein, 191 aa, Homo sapiens
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKKVRPSRWVVGTLLSEDVA

SEQ ID NO: 819303 - protein, 191 aa, Homo sapiens; identical to SEQ ID NO: 819302

SEQ ID NO: 819304 - protein, 202 aa, Homo sapiens
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKQGTGDIRRRNFQILPAKLQQEWILSQQTV

SEQ ID NO: 819305 - protein, 262 aa, Homo sapiens
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQMYFNVHIFIL

SEQ ID NO: 819306 - protein, 191 aa, Homo sapiens; identical to SEQ ID NO: 819302

SEQ ID NO: 819307 - protein, 375 aa, Homo sapiens [sequence omitted]

SEQ ID NO: 819308 - protein, 123 aa, Homo sapiens [sequence omitted]

SEQ ID NO: 819309 - protein, 199 aa, Homo sapiens [sequence omitted]

SEQ ID NO: 819310 - protein, 189 aa, Homo sapiens
DWLSSQAIMASPSGKGARALEAPGCGPRPLARDLVDSVDDAEGLYVAVERCPLCNTTRRRLTCAKCVQSGDFVYFDGRDRERFIDKKERLSRLKSKQEEFQKEVLKAMEGKWITDQLRWKIMSCKMRIEQLKQTICKGNEEMEKNSEGLLKTKEKNQKLYSRAQRHQEKKEKIQRHNRKLGDLVFLSLL

SEQ ID NO: 819311 - protein, 123 aa, Homo sapiens [sequence omitted]

SEQ ID NO: 819312 - protein, 199 aa, Homo sapiens [sequence omitted]

SEQ ID NO: 819313 - protein, 182 aa, Homo sapiens
MRIEQLKQTICKGNEEMEKNSEGLLKTKEKNQKLYSRAQRHQEKKEKIQRHNRKLGDLVEKKTIDLRSHYERLANLRRSHILELTSVIFPIEEVKTGVRDPADVSSESDSAMTSSTVSKLAEARRTTYLSGRWVCDDHNGDTSISITGPWISLPNNGDYSAYYSWVEEKKTTQGPGEKQHIL

SEQ ID NO: 819314 - protein, 557 aa, Homo sapiens
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFNQTVQSSGNMTDKSSQDQLLFLFPEFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGVRYSQQGNNEITSSSTISHHGNSAMVTSQSVLQQVSPASLDPGHNLLSPDGKMISVSGGGLPPVSTLTNIHSLSHHNPQQSQNLIMTPLSGVMAIAQSLNTSQAQSVPVINSVAGSLAALQPVQFSQQLHSPHQQPLMQQSPGSHMAQQPFMAAVTQLQNSHMYAHKQEPPQYSHTSRFPSAMVVTDTSSISTLTNMSSSKQCPLQAW

SEQ ID NO: 819315 - protein, 184 aa, Homo sapiens
MVTSQSVLQQVSPASLDPGHNLLSPDGKMISVSGGGLPPVSTLTNIHSLSHHNPQQSQNLIMTPLSGVMAIAQSLNTSQAQSVPVINSVAGSLAALQPVQFSQQLHSPHQQPLMQQSPGSHMAQQPFMAAVTQLQNSHMYAHKQEPPQYSHTSRFPSAMVVTDTSSISTLTNMSSSKQCPLQAW

SEQ ID NO: 819316 - protein, 557 aa, Homo sapiens; identical to SEQ ID NO: 819314

SEQ ID NO: 819317 - protein, 399 aa, Homo sapiens
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFNQTVQSSGNMTDKSSQDQLLFLFPEFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGKQRLGLTASATQPSWFLPRILSGLRVFRGANAFEMILGPLSHCQNILPWK

SEQ ID NO: 819318 - protein, 650 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 819319 - protein, 633 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVETHSYLEEQKFGTGTV

SEQ ID NO: 819320 - protein, 132 aa, Homo sapiens [sequence omitted]

SEQ ID NO: 819321 - protein, 99 aa, Homo sapiens
SSSSANCSGTAMRTPLTASWRNDPDPAPFTPSAEPRPPLFLEPQNPNSQPRAAGSLEVIISHPFVRRLEILISPFQFQNSIPKNSQIVPAASPRGTSSP

SEQ ID NO: 819322 - protein, 642 aa, Homo sapiens [sequence omitted]

SEQ ID NO: 819323 - protein, 565 aa, Homo sapiens
GTFQGGITEAGRADAAEARALRDLEVQNAVLVSPSLSGHYALPFSDGGHHQLPGFVPIAPSSTQNYTQEQFWAVKTPTLILYGELEHILARDVTACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 819324 - protein, 302 aa, Homo sapiens
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKVIMAPVFVGQSTGKETTVSGAQVPVGRLSCPRMGSFLTLQAHTLHLSRDLATSPRTSNRGHKVEVSWEQRAAGMGGAGL

SEQ ID NO: 819325 - protein, 733 aa, Homo sapiens
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 819326 - protein, 733 aa, Homo sapiens; identical to SEQ ID NO: 819325

SEQ ID NO: 819327 - protein, 733 aa, Homo sapiens; identical to SEQ ID NO: 819325

SEQ ID NO: 819328 - protein, 733 aa, Homo sapiens; identical to SEQ ID NO: 819325

SEQ ID NO: 819329 - protein, 386 aa, Homo sapiens
MNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 819330 - protein, 776 aa, Homo sapiens
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYARGDVGGPEPGLGAKSGLEGQGARLESIHLQETSLTLQSCRRYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 819331 - protein, 610 aa, Homo sapiens
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVAAPHTPVCLWRNFSSC

SEQ ID NO: 819332 - protein, 386 aa, Homo sapiens; identical to SEQ ID NO: 819329

SEQ ID NO: 819333 - protein, 454 aa, Homo sapiens [sequence omitted]

SEQ ID NO: 819334 - protein, 441 aa, Homo sapiens
FAARFDSEIPEWVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 819335 - protein, 733 aa, Homo sapiens; identical to SEQ ID NO: 819325

SEQ ID NO: 819336 - protein, 364 aa, Homo sapiens
TLEDLKRPEDLAWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 819337 - protein, 733 aa, Homo sapiens; identical to SEQ ID NO: 819325

SEQ ID NO: 819338 - protein, 733 aa, Homo sapiens; identical to SEQ ID NO: 819325

SEQ ID NO: 819339 - protein, 221 aa, Homo sapiens
LFPIEATIMGVQSYTNDTYKKYKTKTPRQYARRAYCRAMQYADMKEMLRASALRKEEGRSACCDEKPGAGRECEKRESKGSGGRAVWQKFYETSRGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 819340 - protein, 733 aa, Homo sapiens; identical to SEQ ID NO: 819325

SEQ ID NO: 819341 - protein, 481 aa, Homo sapiens
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGGCRPDWLSLPSGEKI

SEQ ID NO: 819342 - protein, 365 aa, Homo sapiens
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTESRWGICTLSTTSLSGPLMPCPLHCP

SEQ ID NO: 819343 - protein, 380 aa, Homo sapiens
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTSFLADSKCNPMKLLGGFLLGFRANQRSPPSGGLPILTKGSP

SEQ ID NO: 819344 - protein, 98 aa, Homo sapiens
MASSPVPAGPLYVIVEYASKGNLREYLQARRPPGLEYCYNPSHNPEEQLSSKDLVSCAYQVARGMEYLASKKVWNLKAPLGNARVGTEPPYVFQPVTY

SEQ ID NO: 819345 - protein, 73 aa, Homo sapiens
MGKTPPGPGLGPAPEPDQLLLSTLPVSLGFPRAAVAPYWTSPEKMEKKLHAVPAAKTVKFKCPSSGTPNPTLR

SEQ ID NO: 819346 - protein, 121 aa, Homo sapiens
ETEVQLFLSRLECNGMISAHCNPCLPSRNNSHKCTFHTKGFFISSPVKPRSLPGRLRTQSFVIPKPFHCKCPAVKMASNWVLACSVCGSSPCAFTCCQTCKHLFVFMTVMGTEVLQRKSVS

SEQ ID NO: 819347 - protein, 84 aa, Homo sapiens
WLCVTSGKLVNPDVAPFTDFYDGDNMFPSRQYHEDVRTDIFKGSEEYLTHSEHYEMPPCMTRSMPGAEGGEVLRFALLPPQQEQ

SEQ ID NO: 819348 - protein, 123 aa, Homo sapiens
RQDLLFITPWHPFRTTPEGVVMGSSRPGARKEGGAHRRRNIPKSGPPCSFLPIPSSCKRKSRLWEQMAEGGSKERAKNDDPQLIVAVKLSEVFFLFCGRRAGGPKVGNKRVPTQNPSCERCAL

SEQ ID NO: 819349 - protein, 123 aa, Homo sapiens; identical to SEQ ID NO: 819348

SEQ ID NO: 819350 - protein, 121 aa, Homo sapiens; identical to SEQ ID NO: 819346

SEQ ID NO: 819351 - protein, 341 aa, Homo sapiens
VCKSQRCKKQRLQQQQQQRRWQQQQQRRQQQQQRRHRWQQQHHQQQQQKKILIKSSPKLSVYPDPHLHSSQERERGKGGRKKKKPNNLAETSQRMLQNSAVLLVLVISASATHEAEQNDSVSPRKSRVAAQNSAEVVRCLNSALQVGCGAFACLENSTCDTDGMYDICKSFLYSAAKFDTQGKAFVKESLKCIANGVTSKVFLAIRRCSTFQRMIAEVQEECYSKLNVCSIAKRNPEAITEVVQLPNHFSNRYYNRLVRSLLECDEDTVSTIRDSLMEKIGPNMASLFHILQTDHCAQTHPRADFNRRRTNEPQKLKVLLRNLRGEEDSPSHIKRTSHESA

SEQ ID NO: 819352 - protein, 477 aa, Homo sapiens
MSVRESPPHLRRFLRRTSQLSAAPCCVLLLNVQLRGCHLDTLVCPQDVGRGLPMLGPIFSHSRLSLNCADRVFITVPAALRTSPVIVSVRRSDLGSLAQTSVTGFTGFRLHDAAHNSALLSTLPAPQQSSFGKVEHLRMDEEDLGGDPVGDAFEALFDVMLFPECHNLAALYHEGFTDVIHPICVTCWSFPGMQKPRSLTCRAQFDGNVTTLMLEVLDAAISGSSWGSQRMLQNSAVLLVLVISASATHEAEQNDSVSPRKSRVAAQNSAEVVRCLNSALQVGCGAFACLENSTCDTDGMYDICKSFLYSAAKFDTQGKAFVKESLKCIANGVTSKVFLAIRRCSTFQRMIAEVQEECYSKLNVCSIAKRNPEAITEVVQLPNHFSNRYYNRLVRSLLECDEDTVSTIRDSLMEKIGPNMASLFHILQTDHCAQTHPRADFNRRRTNEPQKLKVLLRNLRGEEDSPSHIKRTSHESA

SEQ ID NO: 819353 - protein, 341 aa, Homo sapiens; identical to SEQ ID NO: 819351

SEQ ID NO: 819354 - protein, 137 aa, Homo sapiens
KKQRLQQQQQQRRWQQQQQRRQQQQQRRHRWQQQHHQQQQQKKILIKSSPKLSVYPDPHLHSSQERERGKGGRKKKKPNNLAETSQRMLQNSAVLLVLVISASATHEAEQNDSVSPRKSRVAAQNSGKQQTQERFLP

SEQ ID NO: 819355 - protein, 237 aa, Homo sapiens
MSFLKSFPPPGPAEGLLRQQPDTEAVLNGKGLGTGTLYIAESRLSWLDGSGLGFSLEYPTISLHALSRDRSDCLGEHLYVMVNAKFEEESKEPVADEEEEDSDDDVEPITEFRFVPSDKSALEAMFTAMCECQALHPDPEDEDSDDYDGEEYDVEAHEQGQGDIPTFYTYEEGLSHLTAEGQATLERLEGMLSQSVSSQYNMAGVRTEDSIRDYEDGMEVDTTPTVAGQFEDADVDH

SEQ ID NO: 819356 - protein, 260 aa, Homo sapiens
MPAGGGRACAPTPSGPVLPHSAAMSFLKSFPPPGPAEGLLRQQPDTEAVLNGKGLGTGTLYIAESRLSWLDGSGLGFSLEYPTISLHALSRDRSDCLGEHLYVMVNAKFEEESKEPVADEEEEDSDDDVEPITEFRFVPSDKSALEAMFTAMCECQALHPDPEDEDSDDYDGEEYDVEAHEQGQGDIPTFYTYEEGLSHLTAEGQATLERLEGMLSQSVSSQYNMAGVRTEDSIRDYEDGMEVDTTPTVAGQFEDADVDH

SEQ ID NO: 819357 - protein, 109 aa, Homo sapiens
MCECQALHPDPEDEDSDDYDGEEYDVEAHEQGQGDIPTFYTYEEGLSHLTAEGQATLERLEGMLSQSVSSQYNMAGVRTEDSIRDYEDGMEVDTTPTVAGQFEDADVDH

SEQ ID NO: 819358 - protein, 237 aa, Homo sapiens; identical to SEQ ID NO: 819355

SEQ ID NO: 819359 - protein, 237 aa, Homo sapiens; identical to SEQ ID NO: 819355

SEQ ID NO: 819360 - protein, 237 aa, Homo sapiens; identical to SEQ ID NO: 819355

SEQ ID NO: 819361 - protein, 237 aa, Homo sapiens; identical to SEQ ID NO: 819355

SEQ ID NO: 819362 - protein, 237 aa, Homo sapiens; identical to SEQ ID NO: 819355

SEQ ID NO: 819363 - protein, 237 aa, Homo sapiens; identical to SEQ ID NO: 819355

SEQ ID NO: 819364 - protein, 203 aa, Homo sapiens
MSFLKSFPPPGPAEGLLRQQPDTEAVLNGKGLGTGTLYIAESRLSWLDGSGLGFSLEYPTISLHALSRDRSDCLGEHLYVMVNAKFEVEAMFTAMCECQALHPDPEDEDSDDYDGEEYDVEAHEQGQGDIPTFYTYEEGLSHLTAEGQATLERLEGMLSQSVSSQYNMAGVRTEDSIRDYEDGMEVDTTPTVAGQFEDADVDH

SEQ ID NO: 819365 - protein, 109 aa, Homo sapiens; identical to SEQ ID NO: 819357

SEQ ID NO: 819366 - protein, 237 aa, Homo sapiens; identical to SEQ ID NO: 819355

SEQ ID NO: 819367 - protein, 227 aa, Homo sapiens
MSFLKSFPPPGPAEGLLRQQPDTEAVLNGKGLGTGTLYIAESRLSWLDGSGLGFSLEYPTISLHALSRDRSDCLGEHLYVMVNAKFEEESKEPVADEEEEDSDDDVEPITEFRFVPSDKSALEAMFTAMCECQALHPDPEDEDSDDYDGEEYDVEAHEQGQGDIPTFYTYEEGLSHLTAEGQATLERLEGMLSQSVSSQYNMAGVRTEDSIRDYEGIHTPTKARERF

SEQ ID NO: 819368 - protein, 179 aa, Homo sapiens
MSFLKSFPPPGPAEGLLRQQPDTEAVLNGKGLGTGTLYIAESRLSWLDGSGLGFSLEYPTISLHALSRDRSDCLGEHLYVMVNAKFEEESKEPVADEEEEDSDDDVEPITEFRFVPSDKSALEAMFTAMCECQALHPDPEDEDSDDYDGEEYDVEAHDGMEVDTTPTVAGQFEDADVDH

SEQ ID NO: 819369 - protein, 237 aa, Homo sapiens; identical to SEQ ID NO: 819355

SEQ ID NO: 819370 - protein, 237 aa, Homo sapiens; identical to SEQ ID NO: 819355

SEQ ID NO: 819371 - protein, 222 aa, Homo sapiens
MSFLKSFPPPGPAEGLLRQQPDTEAVLNGKGLGTGTLYIAESRLSWLDGSGLGFSLEYPTISLHALSRDRSDCLGEHLYVMVNAKFEEESKEPVADEEEEDSDDDVEPITEFRFVPSDKSALEAMFTAMCECQALHPDPEDEDSDDYDGEEYDVEAHEQGQGDIPTFYTYEEGLSHLTAEGQATLERLEGMLSQSVSSQYNMAGVRTEDSIRDYEGECPFAV

SEQ ID NO: 819372 - protein, 101 aa, Homo sapiens
TCLQRYCLQRYWFAAVTGLQRYWFARGTGSQRQEGICSLLFTLKLSVSGYPLSRPIIPTLTVCIICKLADLCGENAQELGRLRGKERAPFAMFYQSAVITS

SEQ ID NO: 819373 - protein, 132 aa, Homo sapiens
MSFLKSFPPPGPAEGLLRQQPDTEAVLNGKGLGTGTLYIAESRLSWLDGSGLGFSLEYPTISLHALSRDRSDCLGEHLYVMVNAKFEEESKEPVADEEEEDSDDDVEPITEFRFVPSDKSALETELFKVPKS

SEQ ID NO: 819374 - protein, 106 aa, Homo sapiens
RSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKIINEILD

SEQ ID NO: 819375 - protein, 1022 aa, Homo sapiens
MNNNWNVCFFLFCPSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 819376 - protein, 1022 aa, Homo sapiens; identical to SEQ ID NO: 819375

SEQ ID NO: 819377 - protein, 1065 aa, Homo sapiens
RSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQLLKSCHAVSQTQGEGDAADGEIGSRDGPQTSNSSMKLQNAN

SEQ ID NO: 819378 - protein, 714 aa, Homo sapiens
MEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQLLKSCHAVSQTQGEGDAADGEIGSRDGPQTSNSSMKLQNAN

SEQ ID NO: 819379 - protein, 646 aa, Homo sapiens [sequence omitted]

SEQ ID NO: 819380 - protein, 880 aa, Homo sapiens
RSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTTRPGV

SEQ ID NO: 819381 - protein, 904 aa, Homo sapiens
RSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGLVTVEDEQAWMASYNFVGATTIIHPYLSTMINYAQPVKFQGFHVAEERNIHYNMSSFNESVGLGYLKTHAIEFVNYNKTAMSRIYPKGGRVGSSNYYASDFLDAGCQMVLDYQTPVGAVSMTP

SEQ ID NO: 819382 - protein, 528 aa, Homo sapiens
RSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPGRS

SEQ ID NO: 819383 - protein, 42 aa, Homo sapiens
MVLDPPWSPVYSFSYHQHPHPNYLFQKGFETSYQLLGLPRTF

SEQ ID NO: 819384 - protein, 88 aa, Homo sapiens
PKRREEYSLVNARTSLVFLSAFGREEDAEIIVKIFVEFSIASETHKAIQALNGRWFAGRKVVAEVYDQERFDNSVLSAFQTQRGQCNN

SEQ ID NO: 819385 - protein, 418 aa, Homo sapiens
RRDVLLSRQGPANPEGARRVVGGQERVWPAVRRGRGGSMFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKLSIMKDEPEEAELILHDALRLAYQTDNKKAITYTYDLMANLAFIRGQLENAEQLFKATMSYLLGGGMKQEDNAIIEISLKLASIYAAQNRQEFAVAGYEFCISTLEEKIEREKELAEDIMSVEEKANTHLLLGMCLDACARYLLFSKQPSQAQRMYEKALQISEEIQGERHPQTIVLMSDLATTLDAQGRFDEAYIYMQRASDLARQINHPELHMVLSNLAAVLMHRERYTQAKEIYQEALKQAKLKKDEISVQHIREELAELSKKSRPLTNSVKL

SEQ ID NO: 819386 - protein, 418 aa, Homo sapiens; identical to SEQ ID NO: 819385

SEQ ID NO: 819387 - protein, 418 aa, Homo sapiens; identical to SEQ ID NO: 819385

SEQ ID NO: 819388 - protein, 143 aa, Homo sapiens
MCLDACARYLLFSKQPSQAQRMYEKALQISEEIQGERHPQTIVLMSDLATTLDAQGRFDEAYIYMQRASDLARQINHPELHMVLSNLAAVLMHRERYTQAKEIYQEALKQAKLKKDEISVQHIREELAELSKKSRPLTNSVKL

SEQ ID NO: 819389 - protein, 317 aa, Homo sapiens
RGQGRGPGPMTSEPLPAALAWFSRPAAAEEEEQQGADGAAAEDGADEAEAEIIQLLKRAKRKMREEEEEIGDYLFGENGGLGGGMKEGGNIIGIEAGYQKQEFAVAGYEFCISTLEEKIEREKELAEDIMSVETGFHHVSQDGLNLLTLDPPASASQSAVITVEEKANTHLLLGMCLDACARYLLFSKQPSQAQRMYEKALQISEEIQGERHPQTIVLMSDLATTLDAQGRFDEAYIYMQRASDLARQINHPELHMVLSNLAAVLMHRERYTQAKEIYQEALKQAKLKKDEISVQHIREELAELSKKSRPLTNSVKL

SEQ ID NO: 819390 - protein, 418 aa, Homo sapiens; identical to SEQ ID NO: 819385

SEQ ID NO: 819391 - protein, 464 aa, Homo sapiens
RRDVLLSRQGPANPEGARRVVGGQERVWPAVRRGRGGSMFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKLSIMKDEPEEAELILHDALRLAYQTDNKKAITYTYDLMANLAFIRGQLENAEQLFKATMSYLLGGGMKQEDNAIIEISLKLASIYAAQNRQEFAVAGYEFCISTLEEKIEREKELAEDIMSVEEKANTHLLLGMCLDACARYLLFSKQPSQAQRMYEKALQISEEIQGERHPQTIVLMSDLATTLDAQGRFDEAYIYMQRASDLARQINHPELHMVLSNLAAVLMHRAATTVLGPSKEAKATLVMRPSLHPATTTTSGSASPTLAHTMSSVSELACIYSALTLHDNEVTITEDKINALVKAAGVNVEPFWSSLFAMALANVN

SEQ ID NO: 819392 - protein, 302 aa, Homo sapiens
RRDVLLSRQGPANPEGARRVVGGQERVWPAVRRGRGGSMFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKLSIMKDEPEEAELILHDALRLAYQTDNKKAITYTYDLMANLAFIRGQLENAEQLFKATMSYLLGGGMKQEDNAIIEISLKLASIYAAQNRQEFAVAGYEFCISTLEEKIEREKELAEDIMSGRKPIIWALPFLHKRLYFTLLRNGKRSKLGRGKVTYFAK

SEQ ID NO: 819393 - protein, 96 aa, Homo sapiens
LHDNEVTITEDKINALVKAAGVNVEPFWSSLFAMALANVNIGSLIYNVGAGGPAPAAGADQWDPAHSTAAAPAEKKVEANKEESEESDDDMGFWLF

SEQ ID NO: 819394 - protein, 295 aa, Homo sapiens
CCNPAGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPALALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 819395 - protein, 222 aa, Homo sapiens [sequence omitted]

SEQ ID NO: 819396 - protein, 263 aa, Homo sapiens
CCNPAGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPALALQDAQDLYAAGEKIRGTDEMKFITILCTRSATHLLRVKCTQNLHSYFAERLYYAMKGAGTRDGTLIRNIVSRSEIDLNLIKCHFKKMYGKTLSSMIMEDTSGDYKNALLSLVGSDP

SEQ ID NO: 819397 - protein, 251 aa, Homo sapiens
FLRLRHLEKRRCGQSRRSWQSTPAGRGFCPQGLGTKEGVIIEILASRTKNQLREIMKAYEEDYGSSLEEDIQADTSGYLERILVCLLQGSRDDVSSFVDPALALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 819398 - protein, 254 aa, Homo sapiens
MKGLGTKEGVIIEILASRTKNQLREIMKAYEEDYGSSLEEDIQADTSGYLERILVCLLQVSQPEALGSALVWESQQLHPREQPLNSATRVRGSRDDVSSFVDPALALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 819399 - protein, 243 aa, Homo sapiens
CCNPAGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPALALQDAQDLYAAGEKIRGTDEMKFITILCTRSATHLLRVFEEYEKIANKSIEDSIKSETHGSLEEAMLTVVKCTQNLHSYFAERLYYAMKVTVLSSSS

SEQ ID NO: 819400 - protein, 295 aa, Homo sapiens; identical to SEQ ID NO: 819394

SEQ ID NO: 819401 - protein, 295 aa, Homo sapiens; identical to SEQ ID NO: 819394

SEQ ID NO: 819402 - protein, 92 aa, Homo sapiens
TAATAEPGTSKPLLTLMRLLPTGRHQRRLQERPAEPGGQRPLRHRRTRAKTMKPESPGLLTQPRPWTQVGCEGGPSLSVFYFPISSAFQPGF

SEQ ID NO: 819403 - protein, 138 aa, Homo sapiens
GQCTLMLLVDLEYPRGSLRAVPLTCCVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 819404 - protein, 295 aa, Homo sapiens; identical to SEQ ID NO: 819394

SEQ ID NO: 819405 - protein, 452 aa, Homo sapiens
AGCCRETSCSSAAPFAAALARDPNPASPLPEHRPRLHRGPGPPARLAAAMADPKYADLPGIARNEPDVYETSDLPEDDQAEFDAELEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 819406 - protein, 463 aa, Homo sapiens
PPPPPPPPPPPSPLLLQLPPTSARSRPGLLARDPNPASPLPEHRPRLHRGPGPPARLAAAMADPKYADLPGIARNEPDVYETSDLPEDDQAEFDAELEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 819407 - protein, 328 aa, Homo sapiens
AGCCRETSCSSAAPFAAALARDPNPASPLPEHRPRLHRGPGPPARLAAAMADPKYADLPGIARNEPDVYETSDLPEDDQAEFDAELEELTSTSVEHIIVNPNAAYDKFKDKRVGTKGLDFSDRIGKTKRTGYESGEYEMLGEGLGVKETPQQKYQRLLHEVQELTTEVEKIKNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 819408 - protein, 674 aa, Homo sapiens
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 819409 - protein, 674 aa, Homo sapiens; identical to SEQ ID NO: 819408

SEQ ID NO: 819410 - protein, 584 aa, Homo sapiens
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 819411 - protein, 416 aa, Homo sapiens
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGMWIVRIRKMIQKQPWEKLSQTHIPPTRTRGPTSGAGDIDLEKRQRKRKLLRTGEKLSPAPSEWPSMYLERSHRLPGLLLGCPSDCKGGSSAQKPLLMIRTLRLP

SEQ ID NO: 819412 - protein, 674 aa, Homo sapiens; identical to SEQ ID NO: 819408

SEQ ID NO: 819413 - protein, 687 aa, Homo sapiens
KLYFFLPLFQPRHMAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 819414 - protein, 648 aa, Homo sapiens
SLRLGARLGFNPAEAESPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 819415 - protein, 566 aa, Homo sapiens
ERVMRLTEDVDSEDKEDDSEAALGEAESDPHPSHPDQRAHFRGWGYRPGKETEEEEAAEDWGEAEPCPFRVGIYDRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 819416 - protein, 418 aa, Homo sapiens
RYPAPPSPGEASEEKEEKAHKETGKGEAAPGPQSSAPAQRPQLKSWWCQPSDEEEGEVKALGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 819417 - protein, 611 aa, Homo sapiens
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQEIRPHICLLYTHP

SEQ ID NO: 819418 - protein, 633 aa, Homo sapiens
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQASSPVQTTPLSQAVATPSRSSAAAAAALDLSGRRG

SEQ ID NO: 819419 - protein, 360 aa, Homo sapiens
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDEPRRS

SEQ ID NO: 819420 - protein, 456 aa, Homo sapiens
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYRPGEDTEEEEDEDVDSEDKEDDSEAALGEAESDPHPSQEELSPCLTPAARARAWARLRNPPLAPIPALTQTLPSSSVPSSPVQTTPLSQAVATPSRSSAAAAAALDLSGRRG

SEQ ID NO: 819421 - protein, 401 aa, Homo sapiens
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAQEELSPCLTPAARARAWARLRNPPLAPIPALTQTLPSSSVPSSPVQTTPLSQAVATPSRSSAAAAAALDLSGRRG

SEQ ID NO: 819422 - protein, 321 aa, Homo sapiens
IRGSPEAQGRRGILTARRSVDDLWWRRTEKEVAEAGHIERRCNRGSAQRWSQVLEKAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 819423 - protein, 238 aa, Homo sapiens
SLRLVRGWVLDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 819424 - protein, 392 aa, Homo sapiens
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDENQATEDKRTERSKGARKTSVSPRSSGYRPQSWDIFM

SEQ ID NO: 819425 - protein, 297 aa, Homo sapiens
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSFPSFFVC

SEQ ID NO: 819426 - protein, 238 aa, Homo sapiens
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSQLRKITCPQVGRDMINSSSL

SEQ ID NO: 819427 - protein, 158 aa, Homo sapiens
TRLDNTPGVMVDKKLVNSLPIRIPVAVCISCLCPHVCPQVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 819428 - protein, 458 aa, Homo sapiens
MELPLGRCDDSRTWDDDSDPESETDPDAQAKAYVARVLSPPKSGLAFSRPSQLSTPAASPSASEPRAASRVSAVSEPGLLSLPPELLLEICSYLDARLVLHVLSRVCHALRDLVSDHVTWRLRALRRVRAPYPVVEEKNFDWPAACIALEQHLSRWAEDGRWVEYFCLAEGHVASVDSVLLLQGGSLCLSGSRDRNVNLWDLRQLGTESNQVLIKTLGTKRNSTHEGWVWSLAAQDHRVCSGSWDSTVKLWDMAADGQQFGEIKASSAVLCLSYLPDILVTGTYDKKVTIYDPRAGPALLKHQQLHSRPVLTLLADDRHIISGSEDHTLVVVDRRANSVLQRLQLDSYLLCMSYQEPQLWAGDNQGLLHVFANRNGCFQLIRSFDVGHSFPITGIQYSVGALYTTSTDKTIRVHVPTDPPRTICTRRHDNGLNRVCAEGNLVVAGSGDLSLEVWRLQA

SEQ ID NO: 819429 - protein, 458 aa, Homo sapiens; identical to SEQ ID NO: 819428

SEQ ID NO: 819430 - protein, 458 aa, Homo sapiens; identical to SEQ ID NO: 819428

SEQ ID NO: 819431 - protein, 501 aa, Homo sapiens
MELPLGRCDDSRTWDDDSDPESETDPDAQAKAYVARVLSPPKSGLAFSRPSQLSTPAASPSASEPRAASRVSAVSEPGLLSLPPELLLEICSYLDARLVLHVLSRVCHALRDLVSDHVTWRLRALRRVRAPYPVVEEKNFDWPAACIALEQHLSRWAEDGRWVEYFCLAEGHVASVDSVLLLQGGSLCLSGSRDRNVNLWDLRQLGTESNQVLIKTLGTKRNSTHEGWVWSLAAQDHRVCSGSWDSTVKLWDMAADGQQFGEIKASSAVLCLSYLPDILVTGTYDKKVTIYDPRAGPALLKHQQLHSRPVLTLLADDRHIISGSEDHTLVVVDRRANSVLQRLQLDSYLLCMSYQEPQLWAGDNQGLLHVFANRNGCFQLIRAAGAPAPDCPSPRASFLPEPLVVWGRAGLGRASTECCLILLLQSFDVGHSFPITGIQYSVGALYTTSTDKTIRVHVPTDPPRTICTRRHDNGLNRVCAEGNLVVAGSGDLSLEVWRLQA

SEQ ID NO: 819432 - protein, 458 aa, Homo sapiens; identical to SEQ ID NO: 819428

SEQ ID NO: 819433 - protein, 458 aa, Homo sapiens; identical to SEQ ID NO: 819428

SEQ ID NO: 819434 - protein, 458 aa, Homo sapiens; identical to SEQ ID NO: 819428

SEQ ID NO: 819435 - protein, 295 aa, Homo sapiens
MSPGGYARYAAYARPTQWWKGGSLCLSGSRDRNVNLWDLRQLGTESNQVLIKTLGTKRNSTHEGWVWSLAAQDHRVCSGSWDSTVKLWDMAADGQQFGEIKASSAVLCLSYLPDILVTGTYDKKVTIYDPRAGPALLKHQQLHSRPVLTLLADDRHIISGSEDHTLVVVDRRANSVLQRLQLDSYLLCMSYQEPQLWAGDNQGLLHVFANRNGCFQLIRSFDVGHSFPITGIQYSVGALYTTSTDKTIRVHVPTDPPRTICTRRHDNGLNRVCAEGNLVVAGSGDLSLEVWRLQA

SEQ ID NO: 819436 - protein, 249 aa, Homo sapiens
ALDPPVCQALALTNRPGGWVWSLAAQDHRVCSGSWDSTVKLWDMAADGQQFGEIKASSAVLCLSYLPDILVTGTYDKKVTIYDPRAGPALLKHQQLHSRPVLTLLADDRHIISGSEDHTLVVVDRRANSVLQRLQLDSYLLCMSYQEPQLWAGDNQGLLHVFANRNGCFQLIRSFDVGHSFPITGIQYSVGALYTTSTDKTIRVHVPTDPPRTICTRRHDNGLNRVCAEGNLVVAGSGDLSLEVWRLQA

SEQ ID NO: 819437 - protein, 693 aa, Homo sapiens
MAQGSHQIDFQVLHDLRQKFPEVPEVVVSRCMLQNNNNLDACCAVLSQESTRYLYGEGDLNFSDDSGISGLRNHMTSLNLDLQSQNIYHHGREGSRMNGSRTLTHSISDGQLQGGQSNSELFQQEPQTAPAQVPQGFNVFGMSSSSGASNSAPHLGFHLGSKGTSSLSQQTPRFNPIMVTLAPNIQTGRNTPTSLHIHGVPPPVLNSPQGNSIYIRPYITTPGGTTRQTQQHSGWVSQFNPMNPQQVYQPSQPGPWTTCPASNPLSHTSSQQPNQQGHQTSHVYMPISSPTTSQPPTIHSSGSSQSSAHSQYNIQNISTGPRKNQIEIKLEPPQRNNSSKLRSSGPRTSSTSSSVNSQTLNRNQPTVYIAASPPNTDELMSRSQPKVYISANAATGDEQVMRNQPTLFISTNSGASAASRNMSGQVSMGPAFIHHHPPKSRAIGNNSATSPRVVVTQPNTKYTFKITVSPNKPPAVSPGVVSPTFELTNLLNHPDHYVETENIQHLTDPTLAHVDRISETRKLSMGSDDAAYTQALLVHQKARMERLQRELEIQKKKLDKLKSEVNEMENNLTRRRLKRSNSISQIPSLEEMQQLRSCNRQLQIDIDCLTKEIDLFQARGPHFNPSAIHNFYDNIGFVGPVPPKPKDQRSIIKTPKTQDTEDDEGAQWNCTACTFLNHPALIRCEQCEMPRHF

SEQ ID NO: 819438 - protein, 693 aa, Homo sapiens; identical to SEQ ID NO: 819437

SEQ ID NO: 819439 - protein, 693 aa, Homo sapiens; identical to SEQ ID NO: 819437

SEQ ID NO: 819440 - protein, 536 aa, Homo sapiens
MAQGSHQIDFQVLHDLRQKFPEVPEVVVSRCMLQNNNNLDACCAVLSQESTRYLYGEGDLNFSDDSGISGLRNHMTSLNLDLQSQNIYHHGREGSRMNGSRTLTHSISDGQLQGGQSNSELFQQEPQTAPAQVPQGFNVFGMSSSSGASNSAPHLGFHLGSKGTSSLSQQTPRFNPIMVTLAPNIQTGRNTPTSLHIHGVPPPVLNSPQGNSIYIRPYITTPGGTTRQTQQHSGWVSQFNPMNPQQVYQPSQPGPWTTCPASNPLSHTSSQQPNQQGHQTSHVYMPISSPTTSQPPTIHSSGSSQSSAHSQYNIQNISTGPRKNQIEIKLEPPQRNNSSKLRSSGPRTSSTSSSVNSQTLNRNQPTVYIAASPPNTDELMSRSQPKVYISANAATGDEQVMRNQPTLFISTNSGASAASRNMSGQVSMGPAFIHHHPPKSRAIGNNSATSPRVVVTQPNTKYTFKITVSPNKPPAVSPGVVSPTFELTNLLNHPDHYVETENIQHLTDPTLAHVDRISETRKLSMGSDDAAYTQDI

SEQ ID NO: 819441 - protein, 693 aa, Homo sapiens; identical to SEQ ID NO: 819437

SEQ ID NO: 819442 - protein, 546 aa, Homo sapiens
MIALHSIVQSIMELSRPFLNDTRQSYAPNSWLILESYYSMTGPVLFPTLPHGVPPPVLNSPQGNSIYIRPYITTPGGTTRQTQQHSGWVSQFNPMNPQQVYQPSQPGPWTTCPASNPLSHTSSQQPNQQGHQTSHVYMPISSPTTSQPPTIHSSGSSQSSAHSQYNIQNISTGPRKNQIEIKLEPPQRNNSSKLRSSGPRTSSTSSSVNSQTLNRNQPTVYIAASPPNTDELMSRSQPKVYISANAATGDEQVMRNQPTLFISTNSGASAASRNMSGQVSMGPAFIHHHPPKSRAIGNNSATSPRVVVTQPNTKYTFKITVSPNKPPAVSPGVVSPTFELTNLLNHPDHYVETENIQHLTDPTLAHVDRISETRKLSMGSDDAAYTQALLVHQKARMERLQRELEIQKKKLDKLKSEVNEMENNLTRRRLKRSNSISQIPSLEEMQQLRSCNRQLQIDIDCLTKEIDLFQARGPHFNPSAIHNFYDNIGFVGPVPPKPKDQRSIIKTPKTQDTEDDEGAQWNCTACTFLNHPALIRCEQCEMPRHF

SEQ ID NO: 819443 - protein, 693 aa, Homo sapiens; identical to SEQ ID NO: 819437

SEQ ID NO: 819444 - protein, 693 aa, Homo sapiens; identical to SEQ ID NO: 819437

SEQ ID NO: 819445 - protein, 595 aa, Homo sapiens
MAQGSHQIDFQVLHDLRQKFPEVPEVVVSRCMLQNNNNLDACCAVLSQESTRYLYGEGDLNFSDDSGISGLRNHMTSLNLDLQSQNIYHHGREGSRMNGSRTLTHSISDGQLQGGQSNSELFQQEPQTAPAQVPQGFNVFGMSSSSGASNSAPHLGFHLGSKGTSSLSQQTPRFNPIMVTLAPNIQTGRNTPTSLHIHGVPPPVLNSPQGNSIYIRPYITTPGGTTRQTQQHSGWVSQFNPMNPQQVYQPSQPGPWTTCPASNPLSHTSSQQPNQQGHQTSHVYMPISSPTTSQPPTIHSSGSSQSSAHSQYNIQNISTGPRKNQIEIKLEPPQRNNSSKLRSSGPRTSSTSSSVNSQTLNRNQPTVYIAASPPNTDELMSRSQPKVYISANAATGDEQVMRNQPTLFISTNSGASAASRNMSGQVSMGPAFIHHHPPKSRAIGNNSATSPRVVVTQPNTKYTFKITVSPNKPPAVSPGVVSPTFELTNLLNHPDHYVETENIQHLTDPTLAHVDRISETRKLSMGSDDAAYTQALLVHQKARMERLQRELEIQKKKLDKLKSEVNEMENNLTRRRLKRSNSISQIPSVSLYVTV

SEQ ID NO: 819446 - protein, 148 aa, Homo sapiens
MAQGSHQIDFQVLHDLRQKFPEVPEVVVSRCMLQNNNNLDACCAVLSQESTRYLYGEGDLNFSDDSGISGLRNHMTSLNLDLQSQNIYHHGREGSRMNGSRTLTHSISEGPGEHETDDETSTSEGEAPETTRQMRNQHQLRGGPETLR

SEQ ID NO: 819447 - protein, 1203 aa, Homo sapiens
MDKLPPSMRKRLYSLPQQVGAKAWIMDEEEDAEEEGAGGRQDPSRRSIRLRPLPSPSPSAAAGGTESRSSALGAADSEGPARGAGKSSTNGDCRRFRGSLASLGSRGGGSGGTGSGSSHGHLHDSAEERRLIAEGDASPGEDRTPPGLAAEPERPGASAQPAASPPPPQQPPQPASASCEQPSVDTAIKVEGGAAAGDQILPEAEVRLGQAGFMQRQFGAMLQPGVNKFSLRMFGSQKAVEREQERVKSAGFWIIHPYSDFRFYWDLTMLLLMVGNLIIIPVGITFFKDENTTPWIVFNVVSDTFFLIDLVLNFRTGIVVEDNTEIILDPQRIKMKYLKSWFMVDFISSIPVDYIFLIVETRIDSEVYKTARALRIVRFTKILSLLRLLRLSRLIRYIHQWEEIFHMTYDLASAVVRIVNLIGMMLLLCHWDGCLQFLVPMLQDFPDDCWVSINNMVNNSWGKQYSYALFKAMSHMLCIGYGRQAPVGMSDVWLTMLSMIVGATCYAMFIGHATALIQSLDSSRRQYQEKYKQVEQYMSFHKLPPDTRQRIHDYYEHRYQGKMFDEESILGELSEPLREEIINFNCRKLVASMPLFANADPNFVTSMLTKLRFEVFQPGDYIIREGTIGKKMYFIQHGVVSVLTKGNKETKLADGSYFGEICLLTRGRRTASVRADTYCRLYSLSVDNFNEVLEEYPMMRRAFETVALDRLDRIGKKNSILLHKVQHDLNSGVFNYQENEIIQQIVQHDREMAHCAHRVQAAASATPTPTPVIWTPLIQAPLQAAAATTSVAIALTHHPRLPAAIFRPPPGSGLGNLGAGQTPRHLKRLQSLIPSALGSASPASSPSQVDTPSSSSFHIQQLAGFSAPAGLSPLLPSSSSSPPPGACGSPSAPTPSAGVAATTIAGFGHFHKALGGSLSSSDSPLLTPLQPGARSPQAAQPSPAPPGARGGLGLPEHFLPPPPSSRSPSSSPGQLGQPPGELSLGLATGPLSTPETPPRQPEPPSLVAGASGGASPVGFTPRGGLSPPGHSPGPPRTFPSAPPRASGSHGSLLLPPASSPPPPQVPQRRGTPPLTPGRLTQDLKLISASQPALPQDGAQTLRRASPHSSGESMAAFPLFPRAGGGSGGSGSSGGLGPPGRPYGAIPGQHVTLPRKTSSGSLPPPLSLFGARATSSGGPPLTAGPQREPGARPEPVRSKLPSNL

SEQ ID NO: 819448 - protein, 343 aa, Homo sapiens
MAGGRPHLKRSFSIIPCFVFVESVLLGIVILLAYRLEFTDTFPVHTQGFFCYDSTYAKPYPGPEAASRVPPALVYALVTAGPTLTILLGELARAFFPAPPSAVPVIGESTIVSGACCRFSPPVRRLVRFLGVYSFGLFTTTIFANAGQVVTGNPTPHFLSVCRPNYTALGCLPPSPDRPGPDRFVTDQGACAGSPSLVAAARRAFPCKDAALCAYAVTYTAMYVTLVFRVKGSRLVKPSLCLALLCPAFLVGVVRVAEYRNHWSDVLAGFLTGAAIATFLVTCVVHNFQSRPPSGRRLSPWEDLGQAPTMDSPLEKNPRSAGRIRHRHGSPHPSRRTAPAVAT

SEQ ID NO: 819449 - protein, 299 aa, Homo sapiens
MAGGRPHLKRSFSIIPCFVFVESVLLGIVILLAYRLEFTDTFPVHTQGFFCYDSTYAKPYPGPEAASRVPPALVYALVTAGPTLTILLGELARAFFPAPPSAVPVIGESTIVSGACCRFSPPVRRLVRFLGVYSFGLFTTTIFANAGQVVTGNPTPHFLSVCRPNYTALGCLPPSPDRPGPDRFVTDQGACAGSPSLVAAARRAFPCKDAALCAYAVTYTAGHPLAEGSLPGRTWAKPPPWIAPSKRTRGLQAAFDTGTAHPIQVAELRPPWPPDPQLCLLQGPSHVFVAPCAPSSIEV

SEQ ID NO: 819450 - protein, 343 aa, Homo sapiens; identical to SEQ ID NO: 819448

SEQ ID NO: 819451 - protein, 343 aa, Homo sapiens; identical to SEQ ID NO: 819448

SEQ ID NO: 819452 - protein, 318 aa, Homo sapiens
MAGGRPHLKRSFSIIPCFVFVEGFFCYDSTYAKPYPGPEAASRVPPALVYALVTAGPTLTILLGELARAFFPAPPSAVPVIGESTIVSGACCRFSPPVRRLVRFLGVYSFGLFTTTIFANAGQVVTGNPTPHFLSVCRPNYTALGCLPPSPDRPGPDRFVTDQGACAGSPSLVAAARRAFPCKDAALCAYAVTYTAMYVTLVFRVKGSRLVKPSLCLALLCPAFLVGVVRVAEYRNHWSDVLAGFLTGAAIATFLVTCVVHNFQSRPPSGRRLSPWEDLGQAPTMDSPLEKNPRSAGRIRHRHGSPHPSRRTAPAVAT

SEQ ID NO: 819453 - protein, 376 aa, Homo sapiens
MAGGRPHLKRSFSIIPCFVFVESVLLGIVILLAYRLEFTDTFPVHTQGFFCYDSTYAKPYPGPEAASRVPPALVYALVTAGPTLTVDNEDLLGGRWAGKGGGGDGLEGQKTPSWSCPQILLGELARAFFPAPPSAVPVIGESTIVSGACCRFSPPVRRLVRFLGVYSFGLFTTTIFANAGQVVTGNPTPHFLSVCRPNYTALGCLPPSPDRPGPDRFVTDQGACAGSPSLVAAARRAFPCKDAALCAYAVTYTAMYVTLVFRVKGSRLVKPSLCLALLCPAFLVGVVRVAEYRNHWSDVLAGFLTGAAIATFLVTCVVHNFQSRPPSGRRLSPWEDLGQAPTMDSPLEKNPRSAGRIRHRHGSPHPSRRTAPAVAT

SEQ ID NO: 819454 - protein, 122 aa, Homo sapiens
MYVTLVFRVKGSRLVKPSLCLALLCPAFLVGVVRVAEYRNHWSDVLAGFLTGAAIATFLVTCVVHNFQSRPPSGRRLSPWEDLGQAPTMDSPLEKNPRSAGRIRHRHGSPHPSRRTAPAVAT

SEQ ID NO: 819455 - protein, 133 aa, Homo sapiens
KKVCAARPGPADRVSVFASASLAGSPSVHPAAPGQSRRSGGSGGGGLDASECRGWGAGPRVPTLACLGLSFHICTMGVTIRPPSGRRLSPWEDLGQAPTMDSPLEKNPRSAGRIRHRHGSPHPSRRTAPAVAT

SEQ ID NO: 819456 - protein, 343 aa, Homo sapiens; identical to SEQ ID NO: 819448

SEQ ID NO: 819457 - protein, 41 aa, Homo sapiens
MSSLWLWPVGPRGPLAPSVCLFVSGTRGLQAAFDTGTAHPI

SEQ ID NO: 819458 - protein, 496 aa, Homo sapiens
RRLLPAPRPPAPGGARARAPPPPLLQQQLLCRVVAGARAGVPSLPPSPAMSQGSPGDWAPLDPTPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFEVMGGGGGGGCLVAMLTPLQEAYFGMLFPVASRY

SEQ ID NO: 819459 - protein, 573 aa, Homo sapiens
RRLLPAPRPPAPGGARARAPPPPLLQQQLLCRVVAGARAGVPSLPPSPAMSQGSPGDWAPLDPTPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFELFAEEQAEGPNRLLYKDGFSTILHLLLGSPHPAATALHAELCQAGSSQGLSLCQFQNFSLHDPLYGKLFSTYLRPPHTSRGTSQTPNASSPGNPTALANGTVQAPKQKGD

SEQ ID NO: 819460 - protein, 439 aa, Homo sapiens
GVGSRGAPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFEVMGGGGGGGCLVAMLTPLQEAYFGMLFPVASRY

SEQ ID NO: 819461 - protein, 435 aa, Homo sapiens
AAVGQGVLERTLRAWAIDKLEDVEKLFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFEVMGGGGGGGCLVAMLTPLQEAYFGMLFPVASRY

SEQ ID NO: 819462 - protein, 432 aa, Homo sapiens
VWGAGVGRTREDRKMGPFEPWQKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFEVMGGGGGGGCLVAMLTPLQEAYFGMLFPVASRY

SEQ ID NO: 819463 - protein, 377 aa, Homo sapiens
MVRTTASADTQPCPGRTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFEVMGGGGGGGCLVAMLTPLQEAYFGMLFPVASRY

SEQ ID NO: 819464 - protein, 496 aa, Homo sapiens; identical to SEQ ID NO: 819458

SEQ ID NO: 819465 - protein, 311 aa, Homo sapiens
RTKKNRLVRAGVNRPRNFLPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFEVMGGGGGGGCLVAMLTPLQEAYFGMLFPVASRY

SEQ ID NO: 819466 - protein, 573 aa, Homo sapiens; identical to SEQ ID NO: 819459

SEQ ID NO: 819467 - protein, 225 aa, Homo sapiens
ARTPYAPVLIRYPNSRHHQWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFEVMGGGGGGGCLVAMLTPLQEAYFGMLFPVASRY

SEQ ID NO: 819468 - protein, 400 aa, Homo sapiens
RRLLPAPRPPAPGGARARAPPPPLLQQQLLCRVVAGARAGVPSLPPSPAMSQGSPGDWAPLDPTPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGIPRVWWTSEMWPLH

SEQ ID NO: 819469 - protein, 85 aa, Homo sapiens
GSRPASTSIGGRTAAVPWAFSQYAECDPQHPLKGQSDQVSRFLRLRRTVPEKSFPHLACSRAETKIQMPWSPMELVQQASSLCFS

SEQ ID NO: 819470 - protein, 573 aa, Homo sapiens; identical to SEQ ID NO: 819459

SEQ ID NO: 819471 - protein, 436 aa, Homo sapiens
RRLLPAPRPPAPGGARARAPPPPLLQQQLLCRVVAGARAGVPSLPPSPAMSQGSPGDWAPLDPTPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPPPTHLSRHLPDTKCLIPRQPHCSGQWDCASTQAEGRLSASASHPLLLRAALGASPMPQPHLCSCLNFVIVVWLLFF

SEQ ID NO: 819472 - protein, 408 aa, Homo sapiens
RRLLPAPRPPAPGGARARAPPPPLLQQQLLCRVVAGARAGVPSLPPSPAMSQGSPGDWAPLDPTPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSGHGGVLEYSKSLAHSSQPCSHVDVEFLLWYKPALKRRSTNLYGNMFKGPWHRPGISTKELRRNRNDVAVKGRHTLKASRTAPQRTGTAKKPNENTSTGVEQQAERQKKKNEKENKMGS

SEQ ID NO: 819473 - protein, 92 aa, Homo sapiens
LHTPRSTPRDNCGQRGASPWGRTAQIKRFRNYVCMFVCVICVWVLGVCMHTPNDHRPPHTSRGTSQTPNASSPGNPTALANGTVQAPKQKGD

SEQ ID NO: 819474 - protein, 76 aa, Homo sapiens
REDRRHGLSACAVWSFGVCVKIAITVWRFGVCMHTPNDHRPPHTSRGTSQTPNASSPGNPTALANGTVQAPKQKGD

SEQ ID NO: 819475 - protein, 298 aa, Homo sapiens
RRLLPAPRPPAPGGARARAPPPPLLQQQLLCRVVAGARAGVPSLPPSPAMSQGSPGDWAPLDPTPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGV

SEQ ID NO: 819476 - protein, 226 aa, Homo sapiens
RRLLPAPRPPAPGGARARAPPPPLLQQQLLCRVVAGARAGVPSLPPSPAMSQGSPGDWAPLDPTPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGCLGLLRIRVRGQRASREY

SEQ ID NO: 819477 - protein, 548 aa, Homo sapiens
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEECCRKQKQELCEKFDYLYGILEERKNEMTQVITRTQEEKLEHVRALIKKYSDHLENVSKLVESGIQFMDEPEMAVFLQNAKTLLKKISEASKAFQMEKIEHGYENMNHFTVNLNREEKIIREIDFYREDEDEEEEEGGEGEKEGEGEVGGEAVEVEEVENVQTEFPGEDENPEKASELSQVELQAAPGALPVSSPEPPPALPPAADAPVTQGEVVPTGSEQTTESETPVPAAAETADPLFYPSWYKGQTRKATTNPPCTPGSEGLGQIGPPGSEDSNVRKAEVAAAAASERAAVSGKETSAPAATSQIGFEAPPLQGQAAAPASGSGADSEPARHIFSFSWLNSLNE

SEQ ID NO: 819478 - protein, 452 aa, Homo sapiens
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEECCRKQKQELCEKFDYLYGILEERKNEMTQVITRTQEEKLEHVRALIKKYSDHLENVSKLVESGIQFMDEPEMAVFLQNAKTLLKKISEASKAFQMEKIEHGYENMNHFTVNLNREEKIIREIDFYREDEDEEEEEGGEGEKEGEGEVGGEAVEVEEVENVQTEFPGEDENPEKASELSQVELQAAPGALPVSSPEPPPALPPAADAPVTQIGFEAPPLQGQAAAPASGSGADSEPARHIFSFSWLNSLNE

SEQ ID NO: 819479 - protein, 548 aa, Homo sapiens; identical to SEQ ID NO: 819477

SEQ ID NO: 819480 - protein, 330 aa, Homo sapiens
MCEEHEEERINIYCLNCEVPTCSLCKVFGAHKDCQVAPLTHVFQRQKSELSDGIAILVGSNDRVQGVISQLEDTCKTIEECCRKQKQELCEKFDYLYGILEERKNEMTQVITRTQEEKLEHVRALIKKYSDHLENVSKLVESGIQFMDEPEMAVFLQNAKTLLKKISEASKAFQMEKIEHGYENMNHFTVNLNREEKIIREIDFYREDEDEEEEEGGEGEKEGEGEVGGEAVEVEEVENVQTEFPGEDENPEKASELSQVELQAAPGALPVSSPEPPPALPPAADAPVTQIGFEAPPLQGQAAAPASGSGADSEPARHIFSFSWLNSLNE

SEQ ID NO: 819481 - protein, 122 aa, Homo sapiens
MCEEHEEERINIYCLNCEVPTCSLCKVFGAHKDCQVAPLTHVFQRQKSELSDGIAILVGSNDRVQGVISQLEDTCKTIEVSQVTPTASQPSLQCLGVYDFLSATLDIPILTFHSLLLEWPPS

SEQ ID NO: 819482 - protein, 314 aa, Homo sapiens
KKKRCFLFPRYKFTSTPFTLKDILLGDREISAGISSYQLLNYEDESDVSLYGRRGNHIVNDVGINVAGSDSIAVKASFGIVTKHEVEVSTLLKEITTRKINFDHSLIRQSRSSRKAVLCVVMESIRTTRQCSLSVHAGIRGEAMRFHFMDEQNPKGRDKAIVFPAHTTIAFSVFELFIYLDGAFDLCVTSVSKGGFEREETATFALLYRLRNILFERNRRVMDVISRSQLYLDDLFSDYYDKPLSMTDISLKEGTHIRVNLLNHNIPKGPCILCGMGNFKRETVYGCFQCSVDGQKYVRLHAVPCFDIWHKRMK

SEQ ID NO: 819483 - protein, 164 aa, Homo sapiens
KKKRCFLFPRYKFTSTPFTLKDILLGDREISAGISSYQLLNYEDESDVSLYGRRGNHIVNDVGINVAGSDSIAVKASFGIVTKHEVEVSTLLKEITTRKINFDHSLIRQSRSSRKAVLCVVMESIRTTRQCSLSVHAGIRGEAMRVNHTCWVLLLTKVLPWEFF

SEQ ID NO: 819484 - protein, 115 aa, Homo sapiens [sequence omitted]

SEQ ID NO: 819485 - protein, 225 aa, Homo sapiens
DYLSDSLQGYLFIAMRIIWMCSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWEHDKDPESFFKVLMHLKDLGLNFHVSVLGETFTDVPGWKLCTVGVTHFVLKIWFIPKYFQLNICILHLNSFQKGSRISARDQIL

SEQ ID NO: 819486 - protein, 307 aa, Homo sapiens
DYLSDSLQGYLFIAMRIIWMCSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWEHDKDPESFFKVLMHLKDLGLNFHVSVLGETFTDVPDIFSEAKKALGSSVLHWGYLPSKDDYFQVLCMADVVISTAKHEFFGVAMLEAVYCGCYPLCPKDLVYPEIFPAEYLYSTPEQLSKRLQNFCKRPDIIRKHLYKGWKIGFPFFLGASPLHWKIQGPSGFTN

SEQ ID NO: 819487 - protein, 307 aa, Homo sapiens
DYLSDSLQGYLFIAMRIIWMCSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWEHDKDPESFFKVLMHLKDLGLNFHVSVLGETFTDVPDIFSEAKKALGSSVLHWGYLPSKDDYFQVLCMADVVISTAKHEFFGVAMLEAVYCGCYPLCPKDLVYPEIFPAEYLYSTPEQLSKRLQNFCKRPDIIRKHLYKGEIAPFSWAALHGKFRSLLTTEPREDL

SEQ ID NO: 819488 - protein, 273 aa, Homo sapiens
FAESSQALKSSLFTSDMNLLLNSISLLTFLSEFVVIHNGIITNYKDLRKFLESKGYEFESETDTETIAKLIKYVFDNRETEDITFSTLVERVIQQLEGAFALVFKSVHYPGEAVATRRGSPLLIGVRSKYKLSTEQIPILYRTCTLENVKNICKTRMKRLDSSACLHAVGDKAVEFFFASDASAIIEHTNRVIFLEDDDIAAVADGKLSIHRVKRSASDDPSRAIQTLQMELQQIMKGTSVALLLKGTFDADRICFTTRGGGDIRSTDSLVDD

SEQ ID NO: 819489 - protein, 507 aa, Homo sapiens
MCSTTEKLRTLRFQRWSRESFSSWRGSPLLIGVRSKYKLSTEQIPILYRTCTLENVKNICKTRMKRLDSSACLHAVGDKAVEFFFASDASAIIEHTNRVIFLEDDDIAAVADGKLSIHRVKRSASDDPSRAIQTLQMELQQIMKGNFSAFMQKEIFEQPESVFNTMRGRVNFETNTVLLGGLKDHLKEIRRCRRLIVIGCGTSYHAAVATRQVLEELTELPVMVELASDFLDRNTPVFRDDVCFFISQSGETADTLLALRYCKDRGALTVGVTNTVGSSISRETDCGVHINAGPEIGVASTKAYTSQFISLVMFGLMMSEDRISLQNRRQEIIRGLRSLPELIKEVLSLEEKIHDLALELYTQRSLLVMGRGYNYATCLEGALKIKEITYMHSEGILAGELKHGPLALIDKQMPVIMVIMKDPCFAKCQNALQQVTARQGRPIILCSKDDTESSKFAYKTIELPHTVDCLQGILSVIPLQLLSFHLAVLRGYDVDFPRNLAKSVTVE

SEQ ID NO: 819490 - protein, 139 aa, Homo sapiens
MGRGYNYATCLEGALKIKEITYMHSEGILAGELKHGPLALIDKQMPVIMVIMKDPCFAKCQNALQQVTARQGRPIILCSKDDTESSKFAYKTIELPHTVDCLQGILSVIPLQLLSFHLAVLRGYDVDFPRNLAKSVTVE

SEQ ID NO: 819491 - protein, 334 aa, Homo sapiens
PSRRAPGYKGWRPSGRELEPAEPAEPTEPTEEPTEEPQRPNGQTPSSREGAREAATMCGIFAYMNYRVPRTRKEIFETLIKGLQRLEYRGYDSAGVAIDGNNHEVKERHIQLVKKRGKVKALDEELYKQDSMDLKVEFETHFGIAHTRWATHGVPSAVNSHPQRSDKGNEFVVIHNGIITNYKDLRKFLESKGYEFESETDTETIAKLIKYVFDNRETEDITFSTLVERVIQQLEGAFALVFKSVHYPGEAVATRRGSPLLIGVRSKYKLSTEQIPILYRTCKFLKKYRNSTAAGVAGLGSCSGTVSSPLRQGNPTLSQTQQAHSSRSKRFLCN

SEQ ID NO: 819492 - protein, 92 aa, Homo sapiens
CDSHCPVYPAGTPAGLPVGLGKPHIAHRGIHMFWFVVLPVAPSVLLSLVMSPRMRCSALSSPRDPRTSRHQEGPRETHLGCGQAAAAAAGTR

SEQ ID NO: 819493 - protein, 738 aa, Homo sapiens
PSRRAPGYKGWRPSGRELEPAEPAEPTEPTEEPTEEPQRPNGQTPSSREGAREAATMCGIFAYMNYRVPRTRKEIFETLIKGLQRLEYRGYDSAGVAIDGNNHEVKERHIQLVKKRGKVKALDEELYKQDSMDLKVEFETHFGIAHTRWATHGVPSAVNSHPQRSDKGNEFVVIHNGIITNYKDLRKFLESKGYEFESETDTETIAKLIKYVFDNRETEDITFSTLVERVIQQLEGAFALVFKSVHYPGEAVATRRGSPLLIGVRSKYKLSTEQIPILYRTCTLENVKNICKTRMKRLDSSACLHAVGDKAVEFFFASDASAIIEHTNRVIFLEDDDIAAVADGKLSIHRVKRSASDDPSRAIQTLQMELQQIMKGNFSAFMQKEIFEQPESVFNTMRGRVNFETNTVLLGGLKDHLKEIRRCRRLIVIGCGTSYHAAVATRQVLEELTELPVMVELASDFLDRNTPVFRDDVCFFISQSGETADTLLALRYCKDRGALTVGVTNTVGSSISRETDCGVHINAGPEIGVASTKAYTSQFISLVMFGLMMSEDRISLQNRRQEIIRGLRSLPELIKEVLSLEEKIHDLALELYTQRSLLVMGRGYNYATCLEGALKIKEITYMHSEGILAGELKHGPLALIDKQMPVIMVIMKDPCFAKCQNALQQVTARQGRPIILCSKDDTESSKFAYKTIELPHTVDCLQGILSVIPLQLLSFHLAVLRGYDVDFPRNLAKSVTVE

SEQ ID NO: 819494 - protein, 600 aa, Homo sapiens
FAESSQALKSSLFTSDMNLLLNSISLLTFLSEFVVIHNGIITNYKDLRKFLESKGYEFESETDTETIAKLIKYVFDNRETEDITFSTLVERVIQQLEGAFALVFKSVHYPGEAVATRRGSPLLIGVRSKYKLSTEQIPILYRTCTLENVKNICKTRMKRLDSSACLHAVGDKAVEFFFASDASAIIEHTNRVIFLEDDDIAAVADGKLSIHRVKRSASDDPSRAIQTLQMELQQIMKGNFSAFMQKEIFEQPESVFNTMRGRVNFETNTVLLGGLKDHLKEIRRCRRLIVIGCGTSYHAAVATRQVLEELTELPVMVELASDFLDRNTPVFRDDVCFFISQSGETADTLLALRYCKDRGALTVGVTNTVGSSISRETDCGVHINAGPEIGVASTKAYTSQFISLVMFGLMMSEDRISLQNRRQEIIRGLRSLPELIKEVLSLEEKIHDLALELYTQRSLLVMGRGYNYATCLEGALKIKEITYMHSEGILAGELKHGPLALIDKQMPVIMVIMKDPCFAKCQNALQQVTARQGRPIILCSKDDTESSKFAYKTIELPHTVDCLQGILSVIPLQLLSFHLAVLRGYDVDFPRNLAKSVTVE

SEQ ID NO: 819495 - protein, 474 aa, Homo sapiens
MQTKHPSGICNPFLHLLGTLENVKNICKTRMKRLDSSACLHAVGDKAVEFFFASDASAIIEHTNRVIFLEDDDIAAVADGKLSIHRVKRSASDDPSRAIQTLQMELQQIMKGNFSAFMQKEIFEQPESVFNTMRGRVNFETNTVLLGGLKDHLKEIRRCRRLIVIGCGTSYHAAVATRQVLEELTELPVMVELASDFLDRNTPVFRDDVCFFISQSGETADTLLALRYCKDRGALTVGVTNTVGSSISRETDCGVHINAGPEIGVASTKAYTSQFISLVMFGLMMSEDRISLQNRRQEIIRGLRSLPELIKEVLSLEEKIHDLALELYTQRSLLVMGRGYNYATCLEGALKIKEITYMHSEGILAGELKHGPLALIDKQMPVIMVIMKDPCFAKCQNALQQVTARQGRPIILCSKDDTESSKFAYKTIELPHTVDCLQGILSVIPLQLLSFHLAVLRGYDVDFPRNLAKSVTVE

SEQ ID NO: 819496 - protein, 321 aa, Homo sapiens
PSRRAPGYKGWRPSGRELEPAEPAEPTEPTEEPTEEPQRPNGQTPSSREGAREAATMCGIFAYMNYRVPRTRKEIFETLIKGLQRLEYRGYDSAGVAIDGNNHEVKERHIQLVKKRGKVKALDEELYKQDSMDLKVEFETHFGIAHTRWATHGVPSAVNSHPQRSDKGNEFVVIHNGIITNYKDLRKFLESKGYEFESETDTETIAKLIKYVFDNRETEDITFSTLVERVIQQLEGAFALVFKSVHYPGEAVATRRGSPLLIGVRSKYKLSTEQIPILYRTCTLENVKNICKTRMKRLDSSACLHAVGDKAVEFFFASDAR

SEQ ID NO: 819497 - protein, 369 aa, Homo sapiens
PSRRAPGYKGWRPSGRELEPAEPAEPTEPTEEPTEEPQRPNGQTPSSREGAREAATMCGIFAYMNYRVPRTRKEIFETLIKGLQRLEYRGYDSAGVAIDGNNHEVKERHIQLVKKRGKVKALDEELYKQDSMDLKVEFETHFGIAHTRWATHGVPSAVNSHPQRSDKGNEFVVIHNGIITNYKDLRKFLESKGYEFESETDTETIAKLIKYVFDNRETEDITFSTLVERVIQQLEGAFALVFKSVHYPGEAVATRRGSPLLIGVRSKYKLSTEQIPILYRTCTLENVKNICKTRMKRLDSSACLHPPMPPISPVEISASFNIFFSCVAHIPPLLQLLFNLITALFKPWQHFGPCSLPIVKQLEISHARE

SEQ ID NO: 819498 - protein, 38 aa, Homo sapiens
MLACWLQTRQVLEELTELPVMVELASDFLDRNTPVFRD

SEQ ID NO: 819499 - protein, 1046 aa, Homo sapiens
MQKPSGLKPPGRGGKHSSPMGRTSTGSASSSAAVAASSKEGSPLHKQSSGPSSSPAAAAAPEKPGPKAAEVGDDFLGDFVVGERVWVNGVKPGVVQYLGETQFAPGQWAGVVLDDPVGKNDGAVGGVRYFECPALQGIFTRPSKLTRQPTAEGSGSDAHSVESLTAQNLSLHSGTATPPLTSRVIPLRESVLNSSVKTGNESGSNLSDSGSVKRGEKDLRLGDRVLVGGTKTGVVRYVGETDFAKGEWCGVELDEPLGKNDGAVAGTRYFQCPPKFGLFAPIHKVIRIGFPSTSPAKAKKTKRMAMGVSALTHSPSSSSISSVSSVASSVGGRPSRSGLLTETSSRYARKISGTTALQEALKEKQQHIEQLLAERDLERAEVAKATSHICEVEKEIALLKAQHEQYVAEAEEKLQRARLLVESVRKEKVDLSNQLEEERRKVEDLQFRVEEESITKGDLETQTQLEHARIGELEQSLLLEKAQAERLLRELADNRLTTVAEKSRVLQLEEELTLRRGEIEELQQCLLHSGPPPPDHPDAAEILRLRERLLSASKEHQRESGVLRDKYEKALKAYQAEVDKLRAANEKYAQEVAGLKDKVQQATSENMGLMDNWKSKLDSLASDHQKSLEDLKATLNSGPGAQQKEIGELKAVMEGIKMEHQLELGNLQAKHDLETAMHVKEKEALREKLQEAQEELAGLQRHWRAQLEVQASQHRLELQEAQDQRRDAELRVHELEKLDVEYRGQAQAIEFLKEQISLAEKKMLDYERLQRAEAQGKQEVESLREKLLVAENRLQAVEALCSSQHTHMIESNDISEETIRTKETVEGLQDKLNKRDKEVTALTSQTEMLRAQVSALESKCKSGEKKVDALLKEKRRLEAELETVSRKTHDASGQLVLISQELLRKERSLNELRVLLLEANRHSPGPERDLSREVHKAEWRIKEQKLKDDIRGLREKLTGLDKEKSLSDQRRYSLIDPSSAPELLRLQHQLMSTEDALRDALDQAQQVEKLMEAMRSCPDKAQTIGNSGSANGIHQQDKAQKQEDKH

SEQ ID NO: 819500 - protein, 761 aa, Homo sapiens
VACGLPVACGDCGCGLTVLGMGVSALTHSPSSSSISSVSSVASSVGGRPSRSGLLTETSSRYARKISGTTALQEALKEKQQHIEQLLAERDLERAEVAKATSHICEVEKEIALLKAQHEQYVAEAEEKLQRARLLVESVRKEKVDLSNQLEEERRKVEDLQFRVEEESITKGDLETQTQLEHARIGELEQSLLLEKAQAERLLRELADNRLTTVAEKSRVLQLEEELTLRRGEIEELQQCLLHSGPPPPDHPDAAEILRLRERLLSASKEHQRESGVLRDKYEKALKAYQAEVDKLRAANEKYAQEVAGLKDKVQQATSENMGLMDNWKSKLDSLASDHQKSLEDLKATLNSGPGAQQKEIGELKAVMEGIKMEHQLELGNLQAKHDLETAMHVKEKEALREKLQEAQEELAGLQRHWRAQLEVQASQHRLELQEAQDQRRDAELRVHELEKLDVEYRGQAQAIEFLKEQISLAEKKMLDYERLQRAEAQGKQEVESLREKLLVAENRLQAVEALCSSQHTHMIESNDISEETIRTKETVEGLQDKLNKRDKEVTALTSQTEMLRAQVSALESKCKSGEKKVDALLKEKRRLEAELETVSRKTHDASGQLVLISQELLRKERSLNELRVLLLEANRHSPGPERDLSREVHKAEWRIKEQKLKDDIRGLREKLTGLDKEKSLSDQRRYSLIDPSSAPELLRLQHQLMSTEDALRDALDQAQQVEKLMEAMRSCPDKAQTIGNSGSANGIHQQDKAQKQEDKH

SEQ ID NO: 819501 - protein, 1011 aa, Homo sapiens; identical to SEQ ID NO: 746537

SEQ ID NO: 819502 - protein, 1018 aa, Homo sapiens
MQKPSGLKPPGRGGKHSSPMGRTSTGSASSSAAVAASSKEGSPLHKQSSGPSSSPAAAAAPEKPGPKAAEVGDDFLGDFVVGERVWVNGVKPGVVQYLGETQFAPGQWAGVVLDDPVGKNDGAVGGVRYFECPALQGIFTRPSKLTRQPTAEGSGSDAHSVESLTAQNLSLHSGTATPPLTSRVIPLRESVLNSSVKTGNESGSNLSDSGSVKRGEKDLRLGDRVLVGGTKTGVVRYVGETDFAKGEWCGVELDEPLGKNDGAVAGTRYFQCPPKFGLFAPIHKVIRIGFPSTSPAKAKKTKRMAMGVSALTHSPSSSSISSVSSVASSVGGRPSRSGLLTETSSRYARKISGTTALQEALKEKQQHIEQLLAERDLERAEVAKATSHICEVEKEIALLKAQHEQYVAEAEEKLQRARLLVESVRKEKVDLSNQLEEERRKVEDLQFRVEEESITKGDLETQTQLEHARIGELEQSLLLEKAQAERLLRELADNRLTTVAEKSRVLQLEEELTLRRGEIEELQQCLLHSGPPPPDHPDAAEILRLRERLLSASKEHQRESGVLRDKYEKALKAYQAEVDKLRAANEKYAQEVAGLKDKVQQATSENMGLMDNWKSKLDSLASDHQKSLEDLKATLNSGPGAQQKEIGELKAVMEGIKMEHQLELGNLQAKHDLETAMHVKEKEALREKLQEAQEELAGLQRHWRAQLEVQASQHRLELQEAQDQRRDAELRVHELEKLDVEYRGQAQAIEFLKEQISLAEKKMLDYERLQRAEAQGKQEMIESNDISEETIRTKETVEGLQDKLNKRDKEVTALTSQTEMLRAQVSALESKCKSGEKKVDALLKEKRRLEAELETVSRKTHDASGQLVLISQELLRKERSLNELRVLLLEANRHSPGPERDLSREVHKAEWRIKEQKLKDDIRGLREKLTGLDKEKSLSDQRRYSLIDPSSAPELLRLQHQLMSTEDALRDALDQAQQVEKLMEAMRSCPDKAQTIGNSGSANGIHQQDKAQKQEDKH

SEQ ID NO: 819503 - protein, 403 aa, Homo sapiens
MQKPSGLKPPGRGGKHSSPMGRTSTGSASSSAAVAASSKEGSPLHKQSSGPSSSPAAAAAPEKPGPKAAEVGDDFLGDFVVGERVWVNGVKPGVVQYLGETQFAPGQWAGVVLDDPVGKNDGAVGGVRYFECPALQGIFTRPSKLTRQPTAEGSGSDAHSVESLTAQNLSLHSGTATPPLTSRVIPLRESVLNSSVKTGNESGSNLSDSGSVKRGEKDLRLGDRVLVGGTKTGVVRYVGETDFAKGEWCGVELDEPLGKNDGAVAGTRYFQCPPKFGLFAPIHKVIRIGFPSTSPAKAKKTKRMAMGVSALTHSPSSSSISSVSSVASSVGGRPSRSGLLTETSSRYARKISGTTALQEALKEKQQHIEQLLAERDLERAEVAKATSHICEVEKEMPSPQWNC

SEQ ID NO: 819504 - protein, 806 aa, Homo sapiens
QARYEPGVNRPRGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819505 - protein, 70 aa, Homo sapiens
WFTYTAQRHGHHGRGQHSCLLRGRGAVGVWRLLPPGFGAPWALSVSPCWAHYMGQPLLYLAGRLLAPRLC

SEQ ID NO: 819506 - protein, 96 aa, Homo sapiens
ELGTPRLARQGSDGAWAVVSGACRQVGAASLLSPSPASIPGHLPGLPPAGVLRPACQALQQEDRVPWGIHLPAQGTWRCRSALSGCRGYQLNSIMY

SEQ ID NO: 819507 - protein, 105 aa, Homo sapiens
MTGQQGAGLGGRRQSLSPAHPGLGAALDLPLSLLLQAYEGVLQLVEARGRYEELCIVMCVIPATISNNVPGTDFSLGSDTAVNAAMEVRGSWTPACHAQALVGWG

SEQ ID NO: 819508 - protein, 780 aa, Homo sapiens
MAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819509 - protein, 1028 aa, Homo sapiens
QARYEPGVNRPRGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGEAPSADPCTLTWLGPGARQHVLQWRYARLAWVILLGTASEDRGRKGPAGGTGGGLGGVVPQETLGGGTGRAQCTGIWAWRGDEKLWIQAQDMGWPRGGWEGWQMLGVGTTPLQASWRPGQAGLDVWVPMRASTRYQGGQPSLELDAGHVLCCTGWRGSCCVGGLAPSVEGALPGMRGVCCLMAELPSGRVPVTSLLGSVTAALWLYAVALQGCAGVTRIPSRSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819510 - protein, 830 aa, Homo sapiens
MRSMCNQGRGRESSRGGLHVQGSCRGLSRSPQQETGFAKAPAGTDCFFHCSPGSRGQGDRKEEVTSEPGGTSIMSRLGGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819511 - protein, 728 aa, Homo sapiens
QARYEPGVNRPRGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819512 - protein, 806 aa, Homo sapiens; identical to SEQ ID NO: 819504

SEQ ID NO: 819513 - protein, 751 aa, Homo sapiens
MNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819514 - protein, 751 aa, Homo sapiens; identical to SEQ ID NO: 819513

SEQ ID NO: 819515 - protein, 806 aa, Homo sapiens; identical to SEQ ID NO: 819504

SEQ ID NO: 819516 - protein, 419 aa, Homo sapiens
MDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819517 - protein, 780 aa, Homo sapiens
QARYEPGVNRPRGGGSASWARVSAAAMAAVDLEKLRASGAGKAIGVLTSGGDAQGMNAAVRAVTRMGIYVGAKVFLIYEGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819518 - protein, 863 aa, Homo sapiens
FPLLSAYVGRLSARPKLKAFLASPEYVSGHVAGQYTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFQHRMPREQWWLSLRLMLKMLAQYRISMAAYVSGELVAEVTRRTLSMEQGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819519 - protein, 807 aa, Homo sapiens
FPLLSAYVGRLSARPKLKAFLASPEYVSGHVAGQYTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFQHRMPREQWWLSLRLMLKMLAQYRISMAAYVSGELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819520 - protein, 573 aa, Homo sapiens
QARYEPGVNLAEGRRECELGPCFGRRHGRGGPGEAAGVGRGQGHRRPDQRRRRASAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819521 - protein, 806 aa, Homo sapiens; identical to SEQ ID NO: 819504

SEQ ID NO: 819522 - protein, 521 aa, Homo sapiens
TRSPTMNTATVDMPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819523 - protein, 450 aa, Homo sapiens
MAALQVPTSSAASGAACWRSWWRKTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819524 - protein, 806 aa, Homo sapiens; identical to SEQ ID NO: 819504

SEQ ID NO: 819525 - protein, 1029 aa, Homo sapiens
FPLLSAYVGRLSARPKLKAFLASPEYVSGHVAGQYTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFQHRMPREQWWLSLRLMLKMLAQYRISMAAYVSGELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGEAPSADPCTLTWLGPGARQHVLQWRYARLAWVILLGTASEDRGRKGPAGGTGGGLGGVVPQETLGGGTGRAQCTGIWAWRGDEKLWIQAQDMGWPRGGWEGWQMLGVGTTPLQASWRPGQAGLDVWVPMRASTRYQGGQPSLELDAGHVLCCTGWRGSCCVGGLAPSVEGALPGMRGVCCLMAELPSGRVPVTSLLGSVTAALWLYAVALQGCAWCDPNPFRSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819526 - protein, 493 aa, Homo sapiens
MSMRGWLNRQRLGSALASGADWLFIPEAPPEDGWENFMCERLGEPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819527 - protein, 806 aa, Homo sapiens; identical to SEQ ID NO: 819504

SEQ ID NO: 819528 - protein, 797 aa, Homo sapiens
QARYEPGVNRPRGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPGSRGGEPGSMLKNGGPIPDQDGAYGSGSGAGTGGP

SEQ ID NO: 819529 - protein, 768 aa, Homo sapiens
QARYEPGVNRPRGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHARLRSRAPV

SEQ ID NO: 819530 - protein, 209 aa, Homo sapiens
MGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819531 - protein, 317 aa, Homo sapiens
MTGQQGAGLGGRRQSLSPAHPGLGAALDLPLSLLLQAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 819532 - protein, 760 aa, Homo sapiens
QARYEPGVNRPRGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRTGRAWIITQGPGQRIHQGRGLNGGTSVGVTAQGGGQNPCRRHVAPAGSSPRGGCNTAGNTREGVQTTHEEATQEGRPRENDARPDWTGRRDKEQERQQQSTNGWRGAT

SEQ ID NO: 819533 - protein, 636 aa, Homo sapiens
QARYEPGVNRPRGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDAFNSLLGTRAVWSRAPWGSPGSCPALLAVAAPYFRTTSPLGVGWAAHQGACERVRSG

SEQ ID NO: 819534 - protein, 652 aa, Homo sapiens
QARYEPGVNRPRGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMECVQMTKEVQKAMDDKRFDEATQLRGGSFNNWIYKPRPPRKPPKEKSNFSLGILNCGGPGGWAWNAAVRFGVADPAS

SEQ ID NO: 819535 - protein, 594 aa, Homo sapiens
QARYEPGVNRPRGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMEVRGSWTPACHAQALVGWG

SEQ ID NO: 819536 - protein, 285 aa, Homo sapiens
QARYEPGVNRPRGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTRRVFANAPDSACVIGLKKKAVAFSPVTELKKDTDFEHRMPREQWWLSLRLMLKMLAQYRISMAAYVSGELEHVTRRTLSMDKGF

SEQ ID NO: 819537 - protein, 383 aa, Homo sapiens
QARYEPGVNRPRGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDWGPTAGIKTGERGGAAATGRTATDLEGPEATGIRAKALLNHLAPLGAHRGKRGRTREEARRKDTEDTRDTRSTNEM

SEQ ID NO: 819538 - protein, 232 aa, Homo sapiens
QARYEPGVNRPRGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKPPQPPPMPAQRQGSDGAWAVVSGACRQVGAASLLSPSPASIPGHLPGLPPAGVLRPACQALQQEDRVPWGIHLPAQGTWRCRCLEAAAPWLWRPMGPQRLPMLGSLHGPALALPGR

SEQ ID NO: 819539 - protein, 114 aa, Homo sapiens
ELGTPRLARQGSDGAWAVVSGACRQVGAASLLSPSPASIPGHLPGLPPAGVLRPACQALQQEDRVPWGIHLPAQGTWRCRCLEAAAPWLWRPMGPQRLPMLGSLHGPALALPGR

SEQ ID NO: 819540 - protein, 219 aa, Homo sapiens
QARYEPGVNRPRGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTNHQSGVGGDDQDTSNYLS

SEQ ID NO: 819541 - protein, 180 aa, Homo sapiens
MRSMCNQGRGRESSRGGLHVQGSCRGLSRSPQQETGFAKAPAGTDCFFHCSPGSRGQGDRKEEVTSEPGGTSIMSRLGGMNAAVRAVTRMGIYVGAKVFLIYEGYEGLVEGGENIKQANWLSVSNIIQLVRPGNADACCTWTRRQTHRDRPAHTDTHTETDTCTNTHMQTHRHAHRRTHT

SEQ ID NO: 819542 - protein, 123 aa, Homo sapiens
PGRLSWELPLPLPGLAQRGLRIGGRPELVPADSGPAAPLRNEKCHDYYTTEFLYNLYSSEGKGVFDCRTNVLGHLQQVWGRGEALRGLPLFPATICPRPQGSQPSRAPTGTPGRPSGTCALPQ

SEQ ID NO: 819543 - protein, 669 aa, Homo sapiens
MDLRTAVYNAARDGKLQLLQKLLSGRSREELDELTGEVAGGGTPLLIAARYGHLDVVEYLVDRCGASVEAGGSVHFDGETIEGAPPLWAASAAGHLDVVRSLLRRGASVNRTTRTNSTPLRAACFDGHLEVVRYLVGEHQADLEVANRHGHTCLMISCYKGHREIARYLLEQGAQVNRRSAKGNTALHDCAESGSLEILQLLLGCKARMERDGYGMTPLLAASVTGHTNIVEYLIQEQPGQEQVAGGEAQPGLPQEDPSTSQGCAQPQGAPCCSSSPEEPLNGESYESCCPTSREAAVEALELLGATYVDKKRDLLGALKHWRRAMELRHQGGEYLPKPEPPQLVLAYDYSREVNTTEELEALITDPDEMRMQALLIRERILGPSHPDTSYYIRYRGAVYADSGNFERCIRLWKYALDMQQSNLEPLSPMTASSFLSFAELFSYVLQDRAAKGSLGTQIGFADLMGVLTKGVREVERALQLPREPGDSAQFTKALAIILHLLYLLEKVECTPSQEHLKHQTVYRLLKCAPRGKNGFTPLHMAVDKDTTNVGRYPVGRFPSLHVVKVLLDCGADPDSRDFDNNTPLHIAAQNNCPAIMNALIEAGAHMDATNAFKKTAYELLDEKLLARGTMQPFNYVTLQCLAARALDKNKIPYKGFIPEDLEAFIELH

SEQ ID NO: 819544 - protein, 669 aa, Homo sapiens; identical to SEQ ID NO: 819543

SEQ ID NO: 819545 - protein, 669 aa, Homo sapiens; identical to SEQ ID NO: 819543

SEQ ID NO: 819546 - protein, 669 aa, Homo sapiens; identical to SEQ ID NO: 819543

SEQ ID NO: 819547 - protein, 669 aa, Homo sapiens; identical to SEQ ID NO: 819543

SEQ ID NO: 819548 - protein, 718 aa, Homo sapiens
NGALQLPREPGDSAQFTKALAIILHLLYLLEKVECTPSQEHLKHQTVYRLLKCAPRGKNGFTPCPQPKMAAEGDGEGCLPPVRALILRLPVPRRPAHGLAEARTMDLRTAVYNAARDGKLQLLQKLLSGRSREELDELTGEVAGGGTPLLIAARYGHLDVVEYLVDRCGASVEAGGSVHFDGETIEGAPPLWAASAAGHLDVVRSLLRRGASVNRTTRTNSTPLRAACFDGHLEVVRYLVGEHQADLEVANRHGHTCLMISCYKGHREIARYLLEQGAQVNRRSAKGNTALHDCAESGSLEILQLLLGCKARMERDGYGMTPLLAASVTGHTNIVEYLIQEQPGQEQVAGGEAQPGLPQEDPSTSQGCAQPQGAPCCSSSPEEPLNGESYESCCPTSREAAVEALELLGATYVDKKRDLLGALKHWRRAMELRHQGGEYLPKPEPPQLVLAYDYSREVNTTEELEALITDPDEMRMQALLIRERILGPSHPDTSYYIRYRGAVYADSGNFERCIRLWKYALDMQQSNLEPLSPMTASSFLSFAELFSYVLQDRAAKGSLGTQIGFADLMGVLTKGVREVERALQLPREPGDSAQFTKALAIILHLLYLLEKVECTPSQEHLKHQTVYRLLKCAPRGKNGFTPLHMAVDKDTTNVGRYPVGRFPSLHVVKVLLDCGADPDSRDFDNNTPLHIAAQNNCPAIMNALIEAGAHMDATNALA

SEQ ID NO: 819549 - protein, 669 aa, Homo sapiens; identical to SEQ ID NO: 819543

SEQ ID NO: 819550 - protein, 548 aa, Homo sapiens
MDLRTAVYNAARDGKLQLLQKLLSGRSREELDELTGEVAGGGTPLLIAARYGHLDVVEYLVDRCGASVEAGGSVHFDGETIEGAPPLWAASAAGHLDVVRSLLRRGASVNRTTRTNSTPLRAACFDGHLEVVRYLVGEHQADLEVANRHGHTCLMISCYKGHREIARYLLEQGAQVNRRSAKGNTALHDCAESGSLEILQLLLGCKARMERDGYGMTPLLAASVTGHTNIVEYLIQEQPGQEQVAGGEAQPGLPQEDPSTSQGCAQPQGAPCCSSSPEEPLNGESYESCCPTSREAAVEALELLGATYVDKKRDLLGALKHWRRAMELRHQGGEYLPKPEPPQLVLAYDYSREVNTTEELEALITDPDEMRMQALLIRERILGPSHPDTSYYIRYRGAVYADSGNFERCIRLWKYALDMQQSNLEPLSPMTASSFLSFAELFSYVLQDRAAKGSLGTQIGFADLMGVLTKGVREVERALQLPREPGDSAQFTKALAIILHLLYLLEKVECTPSQEHLKHQTVYRLLKCAPRGKNGFTSLSLPKHRAQK

SEQ ID NO: 819551 - protein, 538 aa, Homo sapiens
MARELSESTALDAQSTEDQMELLVIKVEEEEAGFPSSPDLGSEGSRERFRGFRYPEAAGPREALSRLRELCRQWLQPEMHSKEQILELLVLEQFLTILPGNLQSWVREQHPESGEEVVVLLEYLERQLDEPAPQVSGVDQGQELLCCKMALLTPAPGSQSSQFQLMKALLKHESVGSQPLQDRVLQVPVLAHGGCCREDKVVASRLTPESQGLLKVEDVALTLTPEWTQQDSSQGNLCRDEKQENHGSLVSLGDEKQTKSRDLPPAEELPEKEHGKISCHLREDIAQIPTCAEAGEQEGRLQRKQKNATGGRRHICHECGKSFAQSSGLSKHRRIHTGEKPYECEECGKAFIGSSALVIHQRVHTGEKPYECEECGKAFSHSSDLIKHQRTHTGEKPYECDDCGKTFSQSCSLLEHHRIHTGEKPYQCSMCGKAFRRSSHLLRHQRIHTGDKNVQEPEQGEAWKSRMESQLENVETPMSYKCNECERSFTQNTGLIEHQKIHTGEKPYQCNACGKGFTRISYLVQHQRSHVGKNILSQ

SEQ ID NO: 819552 - protein, 538 aa, Homo sapiens; identical to SEQ ID NO: 819551

SEQ ID NO: 819553 - protein, 385 aa, Homo sapiens
MARELSESTALDAQSTEDQMELLVIKVEEEEAGFPSSPDLGSEGSRERFRGFRYPEAAGPREALSRLRELCRQWLQPEMHSKEQILELLVLEQFLTILPGNLQSWVREQHPESGEEVVVLLEYLERQLDEPAPQVSGVDQGQELLCCKMALLTPAPGSQSSQFQLMKALLKHESVGSQPLQDRVLQVPVLAHGGCCREDKVVASRLTPESQGLLKVEDVALTLTPEWTQQDSSQGNLCRDEKQENHGSLVSLGDEKQTKSRDLPPAEELPEKEHGKISCHLREDIAQIPTCAEAGEQEGRLQRKQKNATGGRRHICHECGKSFAQSSGLSKHRRIHTGEKPYECEECGKAFIGSSALVIHQRVHTGENRISAVCVAKPLGEVHIS

SEQ ID NO: 819554 - protein, 403 aa, Homo sapiens
TELPPRPANLAIQPPLSPLRALAPLPEKPGAVPPPQKRMAKVAKDLNPGVKKMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 819555 - protein, 371 aa, Homo sapiens
MGYTYKVIERILEIGAFRPHMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 819556 - protein, 373 aa, Homo sapiens
QSSLPGPRTWPFSRRCPRCAPSRLCLRSQALFPHPRRGWQRWLRTSTQELKRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 819557 - protein, 143 aa, Homo sapiens
MSLCSPDFLVSYGPSPSFQVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 819558 - protein, 201 aa, Homo sapiens
TELPPRPANLAIQPPLSPLRALAPLPEKPGAVPPPQKRMAKVAKDLNPGVKKMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGKARGGRDHCCYHQRQSQ

SEQ ID NO: 819559 - protein, 171 aa, Homo sapiens
QSSLPGPRTWPFSRRCPRCAPSRLCLRSQALFPHPRRGWQRWLRTSTQELKRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGKARGGRDHCCYHQRQSQ

SEQ ID NO: 819560 - protein, 226 aa, Homo sapiens
MFGMQGDVFGLRATFMEGLQYMELIPKEKQPVTGTEGAFYRRRQLMHQLPIYDQDPSRCRGLLENELKLMEEFVKQYKSEALGVGEVALPGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 819561 - protein, 285 aa, Homo sapiens
TELPPRPANLAIQPPLSPLRALAPLPEKPGAVPPPQKRMAKVAKDLNPGVKKMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYKPVPLV

SEQ ID NO: 819562 - protein, 237 aa, Homo sapiens
TELPPRPANLAIQPPLSPLRALAPLPEKPGAVPPPQKRMAKVAKDLNPGVKKMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFGQLLCPTCSKSKRS

SEQ ID NO: 819563 - protein, 507 aa, Homo sapiens
MGAPRSLLLALAAGLAVARPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 819564 - protein, 507 aa, Homo sapiens; identical to SEQ ID NO: 819563

SEQ ID NO: 819565 - protein, 423 aa, Homo sapiens
MGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 819566 - protein, 507 aa, Homo sapiens; identical to SEQ ID NO: 819563

SEQ ID NO: 819567 - protein, 501 aa, Homo sapiens [sequence omitted]

SEQ ID NO: 819568 - protein, 507 aa, Homo sapiens; identical to SEQ ID NO: 819563

SEQ ID NO: 819569 - protein, 507 aa, Homo sapiens; identical to SEQ ID NO: 819563

SEQ ID NO: 819570 - protein, 423 aa, Homo sapiens; identical to SEQ ID NO: 819565

SEQ ID NO: 819571 - protein, 568 aa, Homo sapiens
RAEETSSPVIGELWSPDQTAEASHVSRYGGSRDPVLTLRAFAGPLSPAKVSCCRSFWKWCLAVPILCGCGSQTSTCLCLCAHPLGKEGAAPLPRPDPPSLSSQWIAGGREKRLSLSLGKATFLSVSGLCDLSRRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 819572 - protein, 411 aa, Homo sapiens
MGAPRSLLLALAAGLAVARPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 819573 - protein, 397 aa, Homo sapiens
MGAPRSLLLALAAGLAVARPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKLCPQ

SEQ ID NO: 819574 - protein, 250 aa, Homo sapiens
RCGATGHPRWLRGCGSMAHERLLCPRPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 819575 - protein, 324 aa, Homo sapiens
MGAPRSLLLALAAGLAVARPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHVSDLGPTPWLPVTPTQCYSSLCPQHTHYPQFSGQSFAERSGRGPFGDSLMELDAAVGTLMTAIGDRSSRLETYHGLRSIVCSEDDQRLFKQPPLWLFA

SEQ ID NO: 819576 - protein, 233 aa, Homo sapiens
EKEKAEREVIVREFQEELVDHLKTFSISESPLEGTSHCHINLNETWTSKKKLFQVEIQPEEKHEEFRKLFELISLLNYTADQIRKKNRELEEEATGYKKCLEMTINMLNAFANEDFSCHGDLNTDQLKMDILFKKLKQKFNDLVAEKEAVSSECVNLAKDNEVLHQELLSMRNVQEKCEKLEKDKKMLEEEVLNLKTHMEKDMVELGKLQEYKSELDERAVQEIEKLEEIHLQ

SEQ ID NO: 819577 - protein, 173 aa, Homo sapiens
MALRVVRSVRALLCTLRAVPLPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGWLIKMTLSNPSELDELMSEEAYEKYIKSIEE

SEQ ID NO: 819578 - protein, 141 aa, Homo sapiens
PPRHRLRASIQPAPSGRELPLPAPPPGAGGRGVALRPPHPCEHGAASGAERAGPALHPARGPVTRRALPAEALAAGGGRRPYAAHWTRSALGRVREFLLRGKQLTLGIAIKNEMALVEHGRDTQATFGIRNAFGEIVGFDL

SEQ ID NO: 819579 - protein, 173 aa, Homo sapiens; identical to SEQ ID NO: 819577

SEQ ID NO: 819580 - protein, 173 aa, Homo sapiens; identical to SEQ ID NO: 819577

SEQ ID NO: 819581 - protein, 253 aa, Homo sapiens
APAAPPPRLHPAGSLRPRTAPPRPASRRGWPRRSAATPAPLRTWRCEWCGACGPCSAPCARSRYPPRPARRGPGSWGWAPSVRCALDPLCSRVKLISYMSHLYAASLNLITPNLSSEAQIFFSARQTSNMRKFTEKHEWVTTENGIGTVGISNFAQEALGDVVYCSLPEVGTKLNKQDEFGALESVKAASELYSPLSGEVTEINEALAENPGLVNKSCYEDGWLIKMTLSNPSELDELMSEEAYEKYIKSIEE

SEQ ID NO: 819582 - protein, 147 aa, Homo sapiens
ASLGWMWRPDPVIWLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGWLIKMTLSNPSELDELMSEEAYEKYIKSIEE

SEQ ID NO: 819583 - protein, 125 aa, Homo sapiens
MALRVVRSVRALLCTLRAVPLPAAPCPPRPWQLGVGAVRTLRTGPALLSDEFGALESVKAASELYSPLSGEVTEINEALAENPGLVNKSCYEDGWLIKMTLSNPSELDELMSEEAYEKYIKSIEE

SEQ ID NO: 819584 - protein, 189 aa, Homo sapiens
MALRVVRSVRALLCTLRAVPLPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGFVLFCFVLFCLRWSFALLVQAGVQWHNLGLTATSASPGSSDSSASAP

SEQ ID NO: 819585 - protein, 177 aa, Homo sapiens
MALRVVRSVRALLCTLRAVPLPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGWLIKMTLSNPSELDELMSEEAYEKYIKSIEEVVLN

SEQ ID NO: 819586 - protein, 93 aa, Homo sapiens
PPRHRLRASIQPAPSGRELPLPAPPPGAGGRGVALRPPHPCEHGAASGAERAGPALHPARGPVTRRALPAEALAAGGGRRPYAAHWTRSALGA

SEQ ID NO: 819587 - protein, 161 aa, Homo sapiens
MALRVVRSVRALLCTLRAVPLPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGKLLLEISQGITTTVNILSR

SEQ ID NO: 819588 - protein, 99 aa, Homo sapiens
MALRVVRSVRALLCTLRAVPLPAAPCPPRPWQLGVGAVRTLRTGPALLSVRKFTEKHEWVTTENGIGTVGISNFAQKREMLFIVASLTLGLNSILLYQG

SEQ ID NO: 819589 - protein, 560 aa, Homo sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 819590 - protein, 206 aa, Homo sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGWLLQTPKLLLYLSLKFQPSLFLLYN

SEQ ID NO: 819591 - protein, 77 aa, Homo sapiens
MECLYYFLGFLLLAARLPLDAAKPRVQTTEAVCRFARGRELSRCNPGPGIAGTGRVGSGQRRSGFWSEPQRPETWAA

SEQ ID NO: 819592 - protein, 572 aa, Homo sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 819593 - protein, 560 aa, Homo sapiens; identical to SEQ ID NO: 819589

SEQ ID NO: 819594 - protein, 540 aa, Homo sapiens
MTLGFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 819595 - protein, 542 aa, Homo sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 819596 - protein, 560 aa, Homo sapiens; identical to SEQ ID NO: 819589

SEQ ID NO: 819597 - protein, 239 aa, Homo sapiens
YIIGRGTHTTRLQNPPFFGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 819598 - protein, 115 aa, Homo sapiens
EPGKGTPVRGHGGLKEHGEYGQLSGFLAQLEDPASPLRMANSALISVGCLAIFVTVISLLVYKKHKEYNPIENSPGNVVRSKGLSVFLNRAKAVFFPGNQEKDPLLKNQEFKGVS

SEQ ID NO: 819599 - protein, 555 aa, Homo sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFRPAGSEPYFSVALM

SEQ ID NO: 819600 - protein, 508 aa, Homo sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYK

SEQ ID NO: 819601 - protein, 341 aa, Homo sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLDL

SEQ ID NO: 819602 - protein, 344 aa, Homo sapiens [sequence omitted]

SEQ ID NO: 819603 - protein, 206 aa, Homo sapiens; identical to SEQ ID NO: 819590

SEQ ID NO: 819604 - protein, 363 aa, Homo sapiens
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPAVGLKTKEGRDQLYWKTIKAFQYVHEHYLEDADWFLKADDDTYVILDNLRWLLSKYDPEEPIYFGRRFKPYVKQGYMSGGAGYVLSKEALKRFVDAFKTDKCTHSSSIEDLALGRCMEIMNVEAGDSRDTIGKETFHPFVPEHHLIKGYLPRTFWYWNYNYYPPVEGPGCCSDLAVSFHYVDSTTMYELEYLVYHLRPYGYLYRYQPTLPERILKEISQANKNEDTKVKLGNP

SEQ ID NO: 819605 - protein, 309 aa, Homo sapiens
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPAVGLKTKEGRDQLYWKTIKAFQYVHEHYLEDADWFLKADDDTYVILDNLRWLLSKYDPEEPIYFGRRFKPYVKQGYMSGGAGYVLSKEALKRFVDAFKTDKCTHSSSIEDLALGRCMEIMNVEAGDSRDTIGKETFHPFVPEHHLIKGYLPRTFWYWNYNYYPPVEVSLEILLLCQYLD

SEQ ID NO: 819606 - protein, 363 aa, Homo sapiens; identical to SEQ ID NO: 819604

SEQ ID NO: 819607 - protein, 363 aa, Homo sapiens; identical to SEQ ID NO: 819604

SEQ ID NO: 819608 - protein, 1148 aa, Homo sapiens
MDIRKFFGVIPSGKKLVSETVKKNEKTKSDEETLKAKKGIKEIKVNSSRKEDDFKQKQPSKKKRIIYDSDSESEETLQVKNAKKPPEKLPVSSKPGKISRQDPVTYISETDEEDDFMCKKAASKSKENGRSTNSHLGTSNMKKNEENTKTKNKPLSPIKLTPTSVLDYFGTGSVQRSNKKMVASKRKELSQNTDESGLNDEAIAKQLQLDEDAELERQLHEDEEFARTLAMLDEEPKTKKARKDTEAGETFSSVQANLSKAEKHKYPHKVKTAQVSDERKSYSPRKQSKYESSKESQQHSKSSADKIGEVSSPKASSKLAIMKRKEESSYKEIEPVASKRKENAIKLKGETKTPKKTKSSPAKKESVSPEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEMKKESKLERTPQKNVQGKRKISPSKKESESKKSRPTSKRDSLAKTIKKETDVFWKSLDFKEQVAEETSGDSKARNLADDSSENKVENLLWVDKYKPTSLKTIIGQQGDQSCANKLLRWLRNWQKSSSEDKKHAAKFGKFSGKDDGSSFKAALLSGPPGVGKTTTASLVCQELGYSYVELNASDTRSKSSLKAIVAESLNNTSIKGFYSNGAASSVSTKHALIMDEVDGMAGNEDRGGIQELIGLIKHTKIPIICMCNDRNHPKIRSLVHYCFDLRFQRPRVEQIKGAMMSIAFKEGLKIPPPAMNEIILGANQDIRQVLHNLSMWCARSKALTYDQAKADSHRAKKDIKMGPFDVARKVFAAGEETAHMSLVDKSDLFFHDYSIAPLFVQENYIHVKPVAAGGDMKKHLMLLSRAADSICDGDLVDSQIRSKQNWSLLPAQAIYASVLPGELMRGYMTQFPTFPSWLGKHSSTGKHDRIVQDLALHMSLRTYSSKRTVNMDYLSLLRDALVQPLTSQGVDGVQDVVALMDTYYLMKEDFENIMEISSWGGKPSPFSKLDPKVKAAFTRAYNKEAHLTPYSLQAIKASRHSTSPSLDSEYNEELNEDDSQSDEKDQDAIETDAMIKKKTKSSKPSKPEKDKEPRKGKGKSSKK

SEQ ID NO: 819609 - protein, 1148 aa, Homo sapiens; identical to SEQ ID NO: 819608

SEQ ID NO: 819610 - protein, 1148 aa, Homo sapiens; identical to SEQ ID NO: 819608

SEQ ID NO: 819611 - protein, 1148 aa, Homo sapiens; identical to SEQ ID NO: 819608

SEQ ID NO: 819612 - protein, 1148 aa, Homo sapiens; identical to SEQ ID NO: 819608

SEQ ID NO: 819613 - protein, 1037 aa, Homo sapiens
LLRIVCVAFTATVLKGTSHTCPSHLGTSNMKKNEENTKTKNKPLSPIKLTPTSVLDYFGTGSVQRSNKKMVASKRKELSQNTDESGLNDEAIAKQLQLDEDAELERQLHEDEEFARTLAMLDEEPKTKKARKDTEAGETFSSVQANLSKAEKHKYPHKVKTAQVSDERKSYSPRKQSKYESSKESQQHSKSSADKIGEVSSPKASSKLAIMKRKEESSYKEIEPVASKRKENAIKLKGETKTPKKTKSSPAKKESVSPEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEMKKESKLERTPQKNVQGKRKISPSKKESESKKSRPTSKRDSLAKTIKKETDVFWKSLDFKEQVAEETSGDSKARNLADDSSENKVENLLWVDKYKPTSLKTIIGQQGDQSCANKLLRWLRNWQKSSSEDKKHAAKFGKFSGKDDGSSFKAALLSGPPGVGKTTTASLVCQELGYSYVELNASDTRSKSSLKAIVAESLNNTSIKGFYSNGAASSVSTKHALIMDEVDGMAGNEDRGGIQELIGLIKHTKIPIICMCNDRNHPKIRSLVHYCFDLRFQRPRVEQIKGAMMSIAFKEGLKIPPPAMNEIILGANQDIRQVLHNLSMWCARSKALTYDQAKADSHRAKKDIKMGPFDVARKVFAAGEETAHMSLVDKSDLFFHDYSIAPLFVQENYIHVKPVAAGGDMKKHLMLLSRAADSICDGDLVDSQIRSKQNWSLLPAQAIYASVLPGELMRGYMTQFPTFPSWLGKHSSTGKHDRIVQDLALHMSLRTYSSKRTVNMDYLSLLRDALVQPLTSQGVDGVQDVVALMDTYYLMKEDFENIMEISSWGGKPSPFSKLDPKVKAAFTRAYNKEAHLTPYSLQAIKASRHSTSPSLDSEYNEELNEDDSQSDEKDQDAIETDAMIKKKTKSSKPSKPEKDKEPRKGKGKSSKK

SEQ ID NO: 819614 - protein, 1209 aa, Homo sapiens
MDIRKFFGVIPSGKKLVSETVKKNEKTKSDEETLKAKKGIKEIKVNSSRKEDDFKQKQPSKKKRIIYDSDSESEETLQVKNAKKPPEKLPVSSKPGKISRQDPVTYISETEETITGIIRELYVKGPDPVPDTLSSSPKEKIKRKTKSIGELCRLRETFVDETVQNIKDKKYNEEDDFMCKKAASKSKENGRSTNSHLGTSNMKKNEENTKTKNKPLSPIKLTPTSVLDYFGTGSVQRSNKKMVASKRKELSQNTDESGLNDEAIAKQLQLDEDAELERQLHEDEEFARTLAMLDEEPKTKKARKDTEAGETFSSVQANLSKAEKHKYPHKVKTAQVSDERKSYSPRKQSKYESSKESQQHSKSSADKIGEVSSPKASSKLAIMKRKEESSYKEIEPVASKRKENAIKLKGETKTPKKTKSSPAKKESVSPEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEMKKESKLERTPQKNVQGKRKISPSKKESESKKSRPTSKRDSLAKTIKKETDVFWKSLDFKEQVAEETSGDSKARNLADDSSENKVENLLWVDKYKPTSLKTIIGQQGDQSCANKLLRWLRNWQKSSSEDKKHAAKFGKFSGKDDGSSFKAALLSGPPGVGKTTTASLVCQELGYSYVELNASDTRSKSSLKAIVAESLNNTSIKGFYSNGAASSVSTKHALIMDEVDGMAGNEDRGGIQELIGLIKHTKIPIICMCNDRNHPKIRSLVHYCFDLRFQRPRVEQIKGAMMSIAFKEGLKIPPPAMNEIILGANQDIRQVLHNLSMWCARSKALTYDQAKADSHRAKKDIKMGPFDVARKVFAAGEETAHMSLVDKSDLFFHDYSIAPLFVQENYIHVKPVAAGGDMKKHLMLLSRAADSICDGDLVDSQIRSKQNWSLLPAQAIYASVLPGELMRGYMTQFPTFPSWLGKHSSTGKHDRIVQDLALHMSLRTYSSKRTVNMDYLSLLRDALVQPLTSQGVDGVQDVVALMDTYYLMKEDFENIMEISSWGGKPSPFSKLDPKVKAAFTRAYNKEAHLTPYSLQAIKASRHSTSPSLDSEYNEELNEDDSQSDEKDQDAIETDAMIKKKTKSSKPSKPEKDKEPRKGKGKSSKK

SEQ ID NO: 819615 - protein, 1032 aa, Homo sapiens
MCKKAASKSKENGRSTNSHLGTSNMKKNEENTKTKNKPLSPIKLTPTSVLDYFGTGSVQRSNKKMVASKRKELSQNTDESGLNDEAIAKQLQLDEDAELERQLHEDEEFARTLAMLDEEPKTKKARKDTEAGETFSSVQANLSKAEKHKYPHKVKTAQVSDERKSYSPRKQSKYESSKESQQHSKSSADKIGEVSSPKASSKLAIMKRKEESSYKEIEPVASKRKENAIKLKGETKTPKKTKSSPAKKESVSPEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEMKKESKLERTPQKNVQGKRKISPSKKESESKKSRPTSKRDSLAKTIKKETDVFWKSLDFKEQVAEETSGDSKARNLADDSSENKVENLLWVDKYKPTSLKTIIGQQGDQSCANKLLRWLRNWQKSSSEDKKHAAKFGKFSGKDDGSSFKAALLSGPPGVGKTTTASLVCQELGYSYVELNASDTRSKSSLKAIVAESLNNTSIKGFYSNGAASSVSTKHALIMDEVDGMAGNEDRGGIQELIGLIKHTKIPIICMCNDRNHPKIRSLVHYCFDLRFQRPRVEQIKGAMMSIAFKEGLKIPPPAMNEIILGANQDIRQVLHNLSMWCARSKALTYDQAKADSHRAKKDIKMGPFDVARKVFAAGEETAHMSLVDKSDLFFHDYSIAPLFVQENYIHVKPVAAGGDMKKHLMLLSRAADSICDGDLVDSQIRSKQNWSLLPAQAIYASVLPGELMRGYMTQFPTFPSWLGKHSSTGKHDRIVQDLALHMSLRTYSSKRTVNMDYLSLLRDALVQPLTSQGVDGVQDVVALMDTYYLMKEDFENIMEISSWGGKPSPFSKLDPKVKAAFTRAYNKEAHLTPYSLQAIKASRHSTSPSLDSEYNEELNEDDSQSDEKDQDAIETDAMIKKKTKSSKPSKPEKDKEPRKGKGKSSKK

SEQ ID NO: 819616 - protein, 827 aa, Homo sapiens
MKRKEESSYKEIEPVASKRKENAIKLKGETKTPKKTKSSPAKKESVSPEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEMKKESKLERTPQKNVQGKRKISPSKKESESKKSRPTSKRDSLAKTIKKETDVFWKSLDFKEQVAEETSGDSKARNLADDSSENKVENLLWVDKYKPTSLKTIIGQQGDQSCANKLLRWLRNWQKSSSEDKKHAAKFGKFSGKDDGSSFKAALLSGPPGVGKTTTASLVCQELGYSYVELNASDTRSKSSLKAIVAESLNNTSIKGFYSNGAASSVSTKHALIMDEVDGMAGNEDRGGIQELIGLIKHTKIPIICMCNDRNHPKIRSLVHYCFDLRFQRPRVEQIKGAMMSIAFKEGLKIPPPAMNEIILGANQDIRQVLHNLSMWCARSKALTYDQAKADSHRAKKDIKMGPFDVARKVFAAGEETAHMSLVDKSDLFFHDYSIAPLFVQENYIHVKPVAAGGDMKKHLMLLSRAADSICDGDLVDSQIRSKQNWSLLPAQAIYASVLPGELMRGYMTQFPTFPSWLGKHSSTGKHDRIVQDLALHMSLRTYSSKRTVNMDYLSLLRDALVQPLTSQGVDGVQDVVALMDTYYLMKEDFENIMEISSWGGKPSPFSKLDPKVKAAFTRAYNKEAHLTPYSLQAIKASRHSTSPSLDSEYNEELNEDDSQSDEKDQDAIETDAMIKKKTKSSKPSKPEKDKEPRKGKGKSSKK

SEQ ID NO: 819617 - protein, 827 aa, Homo sapiens; identical to SEQ ID NO: 819616

SEQ ID NO: 819618 - protein, 1148 aa, Homo sapiens; identical to SEQ ID NO: 819608

SEQ ID NO: 819619 - protein, 200 aa, Homo sapiens
MRGYMTQFPTFPSWLGKHSSTGKHDRIVQDLALHMSLRTYSSKRTVNMDYLSLLRDALVQPLTSQGVDGVQDVVALMDTYYLMKEDFENIMEISSWGGKPSPFSKLDPKVKAAFTRAYNKEAHLTPYSLQAIKASRHSTSPSLDSEYNEELNEDDSQSDEKDQDAIETDAMIKKKTKSSKPSKPEKDKEPRKGKGKSSKK

SEQ ID NO: 819620 - protein, 776 aa, Homo sapiens
MDIRKFFGVIPSGKKLVSETVKKNEKTKSDEETLKAKKGIKEIKVNSSRKEDDFKQKQPSKKKRIIYDSDSESEETLQVKNAKKPPEKLPVSSKPGKISRQDPVTYISETDEEDDFMCKKAASKSKENGRSTNSHLGTSNMKKNEENTKTKNKPLSPIKLTPTSVLDYFGTGSVQRSNKKMVASKRKELSQNTDESGLNDEAIAKQLQLDEDAELERQLHEDEEFARTLAMLDEEPKTKKARKDTEAGETFSSVQANLSKAEKHKYPHKVKTAQVSDERKSYSPRKQSKYESSKESQQHSKSSADKIGEVSSPKASSKLAIMKRKEESSYKEIEPVASKRKENAIKLKGETKTPKKTKSSPAKKESVSPEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEMKKESKLERTPQKNVQGKRKISPSKKESESKKSRPTSKRDSLAKTIKKETDVFWKSLDFKEQVAEETSGDSKARNLADDSSENKVENLLWVDKYKPTSLKTIIGQQGDQSCANKLLRWLRNWQKSSSEDKKHAAKFGKFSGKDDGSSFKAALLSGPPGVGKTTTASLVCQELGYSYVELNASDTRSKSSLKAIVAESLNNTSIKGFYSNGAASSVSTKHALIMDEVDGMAGNEDRGGIQELIGLIKHTKIPIICMCNDRNHPKIRSLVHYCFDLVRRASE

SEQ ID NO: 819621 - protein, 783 aa, Homo sapiens
MDIRKFFGVIPSGKKLVSETVKKNEKTKSDEETLKAKKGIKEIKVNSSRKEDDFKQKQPSKKKRIIYDSDSESEETLQVKNAKKPPEKLPVSSKPGKISRQDPVTYISETDEEDDFMCKKAASKSKENGRSTNSHLGTSNMKKNEENTKTKNKPLSPIKLTPTSVLDYFGTGSVQRSNKKMVASKRKELSQNTDESGLNDEAIAKQLQLDEDAELERQLHEDEEFARTLAMLDEEPKTKKARKDTEAGETFSSVQANLSKAEKHKYPHKVKTAQVSDERKSYSPRKQSKYESSKESQQHSKSSADKIGEVSSPKASSKLAIMKRKEESSYKEIEPVASKRKENAIKLKGETKTPKKTKSSPAKKESVSPEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEMKKESKLERTPQKNVQGKRKISPSKKESESKKSRPTSKRDSLAKTIKKETDVFWKSLDFKEQVAEETSGDSKARNLADDSSENKVENLLWVDKYKPTSLKTIIGQQGDQSCANKLLRWLRNWQKSSSEDKKHAAKFGKFSGKDDGSSFKAALLSGPPGVGKTTTASLVCQELGYSYVELNASDTRSKSSLKAIVAESLNNTSIKGFYSNGAASSVSTKHALIMDEVDGMAGNEDRGGIQELIGLIKHTKIPIICMCNDRNHPKIRSLVHYCFDLRFQRPRVEQIKVL

SEQ ID NO: 819622 - protein, 728 aa, Homo sapiens
ISFLAPHRSLSPKYSHLVLAHPPDYLKDQLSPRPRPPLGLCHPLPAGRRPVPGRVSPMGTQRLCGRGTQGWPGSSEQHVQEATSSAGLHSGVDELGVRSEPGGRLPERSLGPAHPAPAAMAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVPTYKWKRQVTQRNPVGQKKRKMSLLFDHLEPMELAEHLTYLEYRSFCKILFQDYHSFVTHGCTVDNPVLERFISLFNSVSQWVQLMILSKPTAPQRALVITHFVHVAEKLLQLQNFNTLMAVVGGLSHSSISRLKETHSHVSPETIKLWEGLTELVTATGNYGNYRRRLAACVGFRFPILGVHLKDLVALQLALPDWLDPARTRLNGAKMKQLFSILEELAMVTSLRPPVQANPDLLSLLTVSLDQYQTEDELYQLSLQREPRSKSSPTSPTSCTPPPRPPVLEEWTSAAKPKLDQALVVEHIEKMVESVFRNFDVDGDGHISQEEFQIIRGNFPYLSAFGDLDQNQDGCISREEMVSYFLRSSSVLGGRMGFVHNFQESNSLRPVACRHCKALILGIYKQGLKCRACGVNCHKQCKDRLSVECRRRAQSVSLEGSAPSPSPMHSHHHRAFSFSLPRPGRRGSRPPEIREEEVQTVEDGVFDIHL

SEQ ID NO: 819623 - protein, 609 aa, Homo sapiens
MAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVPTYKWKRQVTQRNPVGQKKRKMSLLFDHLEPMELAEHLTYLEYRSFCKILFQDYHSFVTHGCTVDNPVLERFISLFNSVSQWVQLMILSKPTAPQRALVITHFVHVAEKLLQLQNFNTLMAVVGGLSHSSISRLKETHSHVSPETIKLWEGLTELVTATGNYGNYRRRLAACVGFRFPILGVHLKDLVALQLALPDWLDPARTRLNGAKMKQLFSILEELAMVTSLRPPVQANPDLLSLLTVSLDQYQTEDELYQLSLQREPRSKSSPTSPTSCTPPPRPPVLEEWTSAAKPKLDQALVVEHIEKMVESVFRNFDVDGDGHISQEEFQIIRGNFPYLSAFGDLDQNQDGCISREEMVSYFLRSSSVLGGRMGFVHNFQESNSLRPVACRHCKALILGIYKQGLKCRACGVNCHKQCKDRLSVECRRRAQSVSLEGSAPSPSPMHSHHHRAFSFSLPRPGRRGSRPPEIREEEVQTVEDGVFDIHL

SEQ ID NO: 819624 - protein, 90 aa, Homo sapiens
AGSGAAAWRAGGSRSRSEAGGRERTEVGSARPVRAPCGRSQEGSVRARWEAPGAQPGPSPPRAGGHGRHPGPGQGLHGGGAAPRVHRSLR

SEQ ID NO: 819625 - protein, 80 aa, Homo sapiens
RRTSTVHPAFPSHLPAGPSPAYPHLADEKIEAPRGQVILKVTRGSGRARRGRLWVALRKSPPENSVQELPCPPAWGSEYV

SEQ ID NO: 819626 - protein, 312 aa, Homo sapiens
RGAGPRRGERAGAAAAARPAGGSARRWGRPGRCGLLAAGPKRVRSEPGGRLPERSLGPAHPAPAAMAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVPTYKWKRQVTQRNPVGQKKRKMSLLFDHLEPMELAEHLTYLEYRSFCKILFQDYHSFVTHGCTVDNPVLERFISLFNSVSQWVQLMILSKPTAPQRALVITHFVHVAEEACLTAAEHIQHALM

SEQ ID NO: 819627 - protein, 87 aa, Homo sapiens
TKADIEQLPSYRFNPDSHQSEQTLCVVCFSDFEAGSCSESSPPPIEFPLLKNAVVGSRTHSCLGENTSTRAGSLGVSGQEAGDGGGI

SEQ ID NO: 819628 - protein, 609 aa, Homo sapiens; identical to SEQ ID NO: 819623

SEQ ID NO: 819629 - protein, 640 aa, Homo sapiens
RSASPGTGVRSEPGGRLPERSLGPAHPAPAAMAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVPTYKWKRQVTQRNPVGQKKRKMSLLFDHLEPMELAEHLTYLEYRSFCKILFQDYHSFVTHGCTVDNPVLERFISLFNSVSQWVQLMILSKPTAPQRALVITHFVHVAEKLLQLQNFNTLMAVVGGLSHSSISRLKETHSHVSPETIKLWEGLTELVTATGNYGNYRRRLAACVGFRFPILGVHLKDLVALQLALPDWLDPARTRLNGAKMKQLFSILEELAMVTSLRPPVQANPDLLSLLTVSLDQYQTEDELYQLSLQREPRSKSSPTSPTSCTPPPRPPVLEEWTSAAKPKLDQALVVEHIEKMVESVFRNFDVDGDGHISQEEFQIIRGNFPYLSAFGDLDQNQDGCISREEMVSYFLRSSSVLGGRMGFVHNFQESNSLRPVACRHCKALILGIYKQGLKCRACGVNCHKQCKDRLSVECRRRAQSVSLEGSAPSPSPMHSHHHRAFSFSLPRPGRRGSRPPEIREEEVQTVEDGVFDIHL

SEQ ID NO: 819630 - protein, 674 aa, Homo sapiens
RGAGPRRGERAGAAAAARPAGGSARRWGRPGRCGLLAAGPKRVRSEPGGRLPERSLGPAHPAPAAMAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVPTYKWKRQVTQRNPVGQKKRKMSLLFDHLEPMELAEHLTYLEYRSFCKILFQDYHSFVTHGCTVDNPVLERFISLFNSVSQWVQLMILSKPTAPQRALVITHFVHVAEKLLQLQNFNTLMAVVGGLSHSSISRLKETHSHVSPETIKLWEGLTELVTATGNYGNYRRRLAACVGFRFPILGVHLKDLVALQLALPDWLDPARTRLNGAKMKQLFSILEELAMVTSLRPPVQANPDLLSLLTVSLDQYQTEDELYQLSLQREPRSKSSPTSPTSCTPPPRPPVLEEWTSAAKPKLDQALVVEHIEKMVESVFRNFDVDGDGHISQEEFQIIRGNFPYLSAFGDLDQNQDGCISREEMVSYFLRSSSVLGGRMGFVHNFQESNSLRPVACRHCKALILGIYKQGLKCRACGVNCHKQCKDRLSVECRRRAQSVSLEGSAPSPSPMHSHHHRAFSFSLPRPGRRGSRPPEIREEEVQTVEDGVFDIHL

SEQ ID NO: 819631 - protein, 655 aa, Homo sapiens
KLPQGPPRAGREGAPGGGGAAGGVRSEPGGRLPERSLGPAHPAPAAMAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVPTYKWKRQVTQRNPVGQKKRKMSLLFDHLEPMELAEHLTYLEYRSFCKILFQDYHSFVTHGCTVDNPVLERFISLFNSVSQWVQLMILSKPTAPQRALVITHFVHVAEKLLQLQNFNTLMAVVGGLSHSSISRLKETHSHVSPETIKLWEGLTELVTATGNYGNYRRRLAACVGFRFPILGVHLKDLVALQLALPDWLDPARTRLNGAKMKQLFSILEELAMVTSLRPPVQANPDLLSLLTVSLDQYQTEDELYQLSLQREPRSKSSPTSPTSCTPPPRPPVLEEWTSAAKPKLDQALVVEHIEKMVESVFRNFDVDGDGHISQEEFQIIRGNFPYLSAFGDLDQNQDGCISREEMVSYFLRSSSVLGGRMGFVHNFQESNSLRPVACRHCKALILGIYKQGLKCRACGVNCHKQCKDRLSVECRRRAQSVSLEGSAPSPSPMHSHHHRAFSFSLPRPGRRGSRPPEIREEEVQTVEDGVFDIHL

SEQ ID NO: 819632 - protein, 609 aa, Homo sapiens; identical to SEQ ID NO: 819623

SEQ ID NO: 819633 - protein, 511 aa, Homo sapiens [sequence omitted]

SEQ ID NO: 819634 - protein, 464 aa, Homo sapiens
MSLLFDHLEPMELAEHLTYLEYRSFCKILFQDYHSFVTHGCTVDNPVLERFISLFNSVSQWVQLMILSKPTAPQRALVITHFVHVAEKLLQLQNFNTLMAVVGGLSHSSISRLKETHSHVSPETIKLWEGLTELVTATGNYGNYRRRLAACVGFRFPILGVHLKDLVALQLALPDWLDPARTRLNGAKMKQLFSILEELAMVTSLRPPVQANPDLLSLLTVSLDQYQTEDELYQLSLQREPRSKSSPTSPTSCTPPPRPPVLEEWTSAAKPKLDQALVVEHIEKMVESVFRNFDVDGDGHISQEEFQIIRGNFPYLSAFGDLDQNQDGCISREEMVSYFLRSSSVLGGRMGFVHNFQESNSLRPVACRHCKALILGIYKQGLKCRACGVNCHKQCKDRLSVECRRRAQSVSLEGSAPSPSPMHSHHHRAFSFSLPRPGRRGSRPPEIREEEVQTVEDGVFDIHL

SEQ ID NO: 819635 - protein, 349 aa, Homo sapiens
WGYDSSVLCPQLWEGLTELVTATGNYGNYRRRLAACVGFRFPILGVHLKDLVALQLALPDWLDPARTRLNGAKMKQLFSILEELAMVTSLRPPVQANPDLLSLLTVSLDQYQTEDELYQLSLQREPRSKSSPTSPTSCTPPPRPPVLEEWTSAAKPKLDQALVVEHIEKMVESVFRNFDVDGDGHISQEEFQIIRGNFPYLSAFGDLDQNQDGCISREEMVSYFLRSSSVLGGRMGFVHNFQESNSLRPVACRHCKALILGIYKQGLKCRACGVNCHKQCKDRLSVECRRRAQSVSLEGSAPSPSPMHSHHHRAFSFSLPRPGRRGSRPPEIREEEVQTVEDGVFDIHL

SEQ ID NO: 819636 - protein, 626 aa, Homo sapiens
ISFLAPHRSLSPKYSHLVLAHPPDYLKDQLSPRPRPPLGLCHPLPAGRRPVPGRVSPMGTQRLCGRGTQGWPGSSEQHVQEATSSAGLHSGVDELGVRSEPGGRLPERSLGPAHPAPAAMAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVPTYKWKRQVTQRNPVGQKKRKMSLLFDHLEPMELAEHLTYLEYRSFCKILFQDYHSFVTHGCTVDNPVLERFISLFNSVSQWVQLMILSKPTAPQRALVITHFVHVAEKLLQLQNFNTLMAVVGGLSHSSISRLKETHSHVSPETIKLWEGLTELVTATGNYGNYRRRLAACVGFRFPILGVHLKDLVALQLALPDWLDPARTRLNGAKMKQLFSILEELAMVTSLRPPVQANPDLLSLLTVSLDQYQTEDELYQLSLQREPRSKSSPTAHEVDPNTPGPGTDGVDSVQTKWIRPRGSNREEGELGPNCVMGRHISHEIRPPGMLLRLGPTPTEVAHEEESNRPTVWAGTQDTRHTNKREKRHSRKRTKRRRDTTNTQKLDGE

SEQ ID NO: 819637 - protein, 163 aa, Homo sapiens
MCRAGVPFRGARLCQNLGVRGVRELGPQGGPCTANGRGATEWACAPMGVCACVWECTCVERHCLACVHTCEDVSACVAAGLKAGLAQVNSTSRRRPRPRGFGPSPVGGSRSAAWAQPTPRRRPWQAPWTWTRAARWRSCSAGASKPSMTPGRCGTRSWCACSS

SEQ ID NO: 819638 - protein, 150 aa, Homo sapiens
MCRAGVPFRGARLCQNLGVRGVRELGPQGGPCTANGRGATEWACAPMGVCACVWECTCVERHCLACVHTCEDVSACVAAGLKAGLAQVNSTSRRRPRPRGFGPSPVGGSRSAAWAQPTPRRRPWQAPWTWTRAARWRSCSAGASKPSLAA

SEQ ID NO: 819639 - protein, 148 aa, Homo sapiens
MAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVCVGGAQRAGGALSILYHLCLINVC

SEQ ID NO: 819640 - protein, 219 aa, Homo sapiens
VAVFVEAIQQQSFPNHSSCSGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESGIDLSFLCEIRQTPEFEQFHYEYYCPLKEWVAGKVHLILYMLGCS

SEQ ID NO: 819641 - protein, 213 aa, Homo sapiens
MQAEETKGIGITSMAKCLVKIQTRRSLQLHMVNHCNSNVFVRLLRLGSKVTARNTGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESVSMQ

SEQ ID NO: 819642 - protein, 668 aa, Homo sapiens
GGEAEASEQREGPARRAPAAGHVCPQAPDAADVPGLSRAQVSRTVRASVCVRAGEHRAGPEPPARSPRPRCMFASCHCVPRGRRTMKMIHFRSSSVKSLSQEMRCTIRLLDDSEISCHIQRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHNNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESGIDLSFLCEIRQTPEFEQFHYEYYCPLKEWVAGKVHLILYMLGCS

SEQ ID NO: 819643 - protein, 254 aa, Homo sapiens
MQAEETKGIGITSMAKCLVKIQTRRSLQLHMVNHCNSNVFVRLLRLGSKVTARNTGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESGIDLSFLCEIRQTPEFEQFHYEYYCPLKEWVAGKVHLILYMLGCS

SEQ ID NO: 819644 - protein, 403 aa, Homo sapiens
MVFRRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESGIDLSFLCEIRQTPEFEQFHYEYYCPLKEWVAGKVHLILYMLGCS

SEQ ID NO: 819645 - protein, 627 aa, Homo sapiens
GGEAEASEQREGPARRAPAAGHVCPQAPDAADVPGLSRAQVSRTVRASVCVRAGEHRAGPEPPARSPRPRCMFASCHCVPRGRRTMKMIHFRSSSVKSLSQEMRCTIRLLDDSEISCHIQRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHNNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESVSMQ

SEQ ID NO: 819646 - protein, 442 aa, Homo sapiens
GGEAEASEQREGPARRAPAAGHVCPQAPDAADVPGLSRAQVSRTVRASVCVRAGEHRAGPEPPARSPRPRCMFASCHCVPRGRRTMKMIHFRSSSVKSLSQEMRCTIRLLDDSEISCHIQRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHNNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRCVQKKICSCFGVTW

SEQ ID NO: 819647 - protein, 57 aa, Homo sapiens
EITLQTPSHPQTPSHPQTPRSGVRTKFGINMVTSRERGTTRLPIGGVKFVGERGGYR

SEQ ID NO: 819648 - protein, 373 aa, Homo sapiens
MLRSVWNFLKRHKKKCIFLGTVLGGVYILGKYGQKKIREIQEREAAEYIAQARRQYHFESNQRTCNMTVLSMLPTLREALMQQLNSESLTALLKNRPSNKLEIWEDLKIISFTRSTVAVYSTCMLVVLLRVQLNIIGGYIYLDNAAVGKNGTTILAPPDVQQQYLSSIQHLLGDGLTELITVIKQAVQKVLGSVSLKHSLSLLDLEQKLKEIRNLVEQHKSSSWINKDGSKPLLCHYMMPDEETPLAVQACGLSPRDITTIKLLNETRDMLESPDFSTVLNTCLNRGFSRLLDNMAEFFRPTEQDLQHGNSMNSLSSVSLPLAKIIPIVNGQIHSVCSETPSHFVQDLLTMEQVKDFAANVYEAFSTPQQLEK

SEQ ID NO: 819649 - protein, 373 aa, Homo sapiens; identical to SEQ ID NO: 819648

SEQ ID NO: 819650 - protein, 373 aa, Homo sapiens; identical to SEQ ID NO: 819648

SEQ ID NO: 819651 - protein, 316 aa, Homo sapiens
MLRSVWNFLKRHKKKCIFLGTVLGGVYILGKYGQKKIREIQEREAAEYIAQARRQYHFESNQRTCNMTVLSMLPTLREALMQQLNSESLTALLKNRPSNKLEIWEDLKIISFTRSTVAVYSTCMLVVLLRVQLNIIGGYIYLDNAAVGKNGTTILAPPDVQQQYLSSIQHLLGDGLTELITVIKQAVQKVLGSVSLKHSLSLLDLEQKLKEIRNLVEQHKSSSWINKDGSKPLLCHYMMPDEETPLAVQACGLSPRDITTIKLLNETRDMLESPDFSTVLNTCLNRGFSRLLDNMAEFFRPTEQDLQHGNSMNRIC

SEQ ID NO: 819652 - protein, 373 aa, Homo sapiens; identical to SEQ ID NO: 819648

SEQ ID NO: 819653 - protein, 219 aa, Homo sapiens
MLRSVWNFLKRHKKKCIFLGTVLGGVYILGKYGQKKIREIQEREAAEYIAQARRQYHFESNQRTCNMTVLSMLPTLREALMQQLNSESLTALLKNRPSNKLEIWEDLKIISFTRSTVAVYSTCMLVVLLRVQLNIIGGYIYLDNAAVGKNGTTILAPPDVQQQYLSSIQHLLGDGLTELITVIKQAVQKVLGSVSLKHSLSLLDLEQKLMDPNLYYAII

SEQ ID NO: 819654 - protein, 329 aa, Homo sapiens
MLRSVWNFLKRHKKKCIFLGTVLGVLSMLPTLREALMQQLNSESLTALLKNRPSNKLEIWEDLKIISFTRSTVAVYSTCMLVVLLRVQLNIIGGYIYLDNAAVGKNGTTILAPPDVQQQYLSSIQHLLGDGLTELITVIKQAVQKVLGSVSLKHSLSLLDLEQKLKEIRNLVEQHKSSSWINKDGSKPLLCHYMMPDEETPLAVQACGLSPRDITTIKLLNETRDMLESPDFSTVLNTCLNRGFSRLLDNMAEFFRPTEQDLQHGNSMNSLSSVSLPLAKIIPIVNGQIHSVCSETPSHFVQDLLTMEQVKDFAANVYEAFSTPQQLEK

SEQ ID NO: 819655 - protein, 149 aa, Homo sapiens
MISLFFLMSPRLECSGTILVHCNLHLPGSSDPPTPASRVDGTTGMCHHAWLIFVFLVQTRFHHVDQAGLELLILSDLPALASQSAGITGVSYCTRPAFFLVKRICGSFYSHGCLPQVNLFPRKWHHLWTVVSPSSFSSFSSSSSSTMPG

SEQ ID NO: 819656 - protein, 147 aa, Homo sapiens
MALKRIHKELNDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDREKYNRIAREWTQKYAM

SEQ ID NO: 819657 - protein, 147 aa, Homo sapiens; identical to SEQ ID NO: 819656

SEQ ID NO: 819658 - protein, 187 aa, Homo sapiens
AGFAASRPPGPWRRRRCVAYSQGRPVSLRRRRGSALPPLAANPRASRPAPRSGPPRAPTAPPRRRSPPARASLGPPAAGRKTGNPSGCPTKRGRPSPRLGLLLSGGGICGGLGGGADPGRKRQLRRRRRWRLGRRRIKGPPPGDAVTAAAGPGAEWAPALSPSRRTRFPQLSIFSCRPRSPRRPQAP

SEQ ID NO: 819659 - protein, 126 aa, Homo sapiens
MIWHGTLQHSVQQVLLEMINDSPYQGGVFFLTIHFPTDYPFKPPKVAFTTRIYHPNINSNGSICLDILRSQWSPALTISKVLLSICSLLCDPNPDDPLVPEIARIYKTDREKYNRIAREWTQKYAM

SEQ ID NO: 819660 - protein, 147 aa, Homo sapiens; identical to SEQ ID NO: 819656

SEQ ID NO: 819661 - protein, 156 aa, Homo sapiens
MALKRIHKELNDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDREKNYWITSTNKDRGTLKEKVLLISI

SEQ ID NO: 819662 - protein, 147 aa, Homo sapiens; identical to SEQ ID NO: 819656

SEQ ID NO: 819663 - protein, 147 aa, Homo sapiens; identical to SEQ ID NO: 819656

SEQ ID NO: 819664 - protein, 147 aa, Homo sapiens; identical to SEQ ID NO: 819656

SEQ ID NO: 819665 - protein, 193 aa, Homo sapiens [sequence omitted]

SEQ ID NO: 819666 - protein, 193 aa, Homo sapiens [sequence omitted]

SEQ ID NO: 819667 - protein, 193 aa, Homo sapiens [sequence omitted]

SEQ ID NO: 819668 - protein, 193 aa, Homo sapiens [sequence omitted]

SEQ ID NO: 819669 - protein, 193 aa, Homo sapiens [sequence omitted]

SEQ ID NO: 819670 - protein, 193 aa, Homo sapiens [sequence omitted]

SEQ ID NO: 819671 - protein, 193 aa, Homo sapiens [sequence omitted]

SEQ ID NO: 819672 - protein, 193 aa, Homo sapiens [sequence omitted]

SEQ ID NO: 819673 - protein, 193 aa, Homo sapiens [sequence omitted]

SEQ ID NO: 819674 - protein, 193 aa, Homo sapiens [sequence omitted]

SEQ ID NO: 819675 - protein, 208 aa, Homo sapiens
MSWVEAAGVSSTALEDRIVAKHEEVPEVSVQYEEKFQNHHKLPSQLSSFSWDNCDEGKDPAVIRSLTLEPDPIVVPGNVTLSVVGSTSVPLSSPLKVDLVLEKEVAGLWIKIPCTDYIGSCTFEHFCDVLDMLIPTGEPCPEPLRTYGLPCHCPFKEGTYSLPKSEFVVPDLELPSWLTTGNYRIESVLSSSGKRLGCIKIAASLKGI

SEQ ID NO: 819676 - protein, 193 aa, Homo sapiens [sequence omitted]

SEQ ID NO: 819677 - protein, 193 aa, Homo sapiens [sequence omitted]

SEQ ID NO: 819678 - protein, 145 aa, Homo sapiens
MQSLMQAPLLIALGLLLAAPAQAHLKKPSQLSSFSWDNCDEGKDPAVIRSLTLEPDPIVVPGNVTLSVVGSTSVPLSSPLKVDLVLEKEVAGLWIKIPCTDYIGSCTFEHFCDVLDMLIPTGEPCPEPLRTYGLPCHCPFKEVST

SEQ ID NO: 819679 - protein, 81 aa, Homo sapiens
DPAVIRSLTLEPDPIVVPGNVTLSVVGSTSVPLSSPLKVSLGVGGEGEVRGSGQQGYWGMYAWGTVKNFRILDSQRIVQDM

SEQ ID NO: 819680 - protein, 336 aa, Homo sapiens
MKTLMRHGLAVCLALTTMCTSLLLVYSSLGGQKERPPQQQQQQQQQQQQASATGSSQPAAESSTQQRPGVPAGPRPLDGYLGVADHKPLKMHCRDCALVTSSGHLLHSRQGSQIDQTECVIRMNDAPTRGYGRDVGNRTSLRVIAHSSIQRILRNRHDLLNVSQGTVFIFWGPSSYMRRDGKGQVYNNLHLLSQVLPRLKAFMITRHKMLQFDELFKQETGKDRKISNTWLSTGWFTMTIALELCDRINVYGMVPPDFCRDPNHPSVPYHYYEPFGPDECTMYLSHERGRKGSHHRFITEKRVFKNWARTFNIHFFQPDWKPESLAINHPENKPVF

SEQ ID NO: 819681 - protein, 336 aa, Homo sapiens; identical to SEQ ID NO: 819680

SEQ ID NO: 819682 - protein, 246 aa, Homo sapiens
MHCRDCALVTSSGHLLHSRQGSQIDQTECVIRMNDAPTRGYGRDVGNRTSLRVIAHSSIQRILRNRHDLLNVSQGTVFIFWGPSSYMRRDGKGQVYNNLHLLSQVLPRLKAFMITRHKMLQFDELFKQETGKDRKISNTWLSTGWFTMTIALELCDRINVYGMVPPDFCRDPNHPSVPYHYYEPFGPDECTMYLSHERGRKGSHHRFITEKRVFKNWARTFNIHFFQPDWKPESLAINHPENKPVF

SEQ ID NO: 819683 - protein, 314 aa, Homo sapiens
MKTLMRHGLAVCLALTTMCTSLLLVYSSLGGQKERPPQQQQQQQQQQQQASATGSSQPAAESSTQQRPGVPAGPRPLDGYLGVADHKPLKMHCRDCALVTSSGHLLHSRQGSQIDQTECVIRMNDAPTRGYGRDVGNRTSLRVIAHSSIQRILRNRHDLLNVSQGTVFIFWGPSSYMRRDGKGQVYNNLHLLSQVLPRLKAFMITRHKMLQFDELFKQETGKDRYKGTGKKMQGRVRISHHWLTHPKQSFCYRLLLWAPLLMSLLEFTCRVLCVTGLLKLTLQDKVKRSMEIIIWIFQGLIFEEEATQLLAFIG

SEQ ID NO: 819684 - protein, 377 aa, Homo sapiens
MAATEDERLAGSGEGERLDFLRDRHVRFFQRCLQVLPERYSSLETSRLTIAFFALSGLDMLDSLDVVNKDDIIEWIYSLQVLPTEDRSNLNRCGFRGSSYLGIPFNPSKAPGTAHPYDSGHIAMTYTGLSCLVILGDDLSRVNKEACLAGLRALQLEDGSFCAVPEGSENDMRFVYCASCICYMLNNWSGMDMKKAITYIRRSMSYDNGLAQGAGLESHGGSTFCGIASLCLMGKLEEVFSEKELNRIKRWCIMRQQNGYHGRPNKPVDTCYSFWVGATLKLLKIFQYTNFEKNRNYILSTQDRLVGGFAKWPDSHPDALHAYFGICGLSLMEESGICKVHPALNVSTRTSERLLDLHQSWKTKDSKQCSENVHIST

SEQ ID NO: 819685 - protein, 377 aa, Homo sapiens; identical to SEQ ID NO: 819684

SEQ ID NO: 819686 - protein, 424 aa, Homo sapiens
MIAVSNTGLVCGGRRSPHPAPCGSAQEGSFSPRALIPGRGGRRFRSSMAATEDERLAGSGEGERLDFLRDRHVRFFQRCLQVLPERYSSLETSRLTIAFFALSGLDMLDSLDVVNKDDIIEWIYSLQVLPTEDRSNLNRCGFRGSSYLGIPFNPSKAPGTAHPYDSGHIAMTYTGLSCLVILGDDLSRVNKEACLAGLRALQLEDGSFCAVPEGSENDMRFVYCASCICYMLNNWSGMDMKKAITYIRRSMSYDNGLAQGAGLESHGGSTFCGIASLCLMGKLEEVFSEKELNRIKRWCIMRQQNGYHGRPNKPVDTCYSFWVGATLKLLKIFQYTNFEKNRNYILSTQDRLVGGFAKWPDSHPDALHAYFGICGLSLMEESGICKVHPALNVSTRTSERLLDLHQSWKTKDSKQCSENVHIST

SEQ ID NO: 819687 - protein, 428 aa, Homo sapiens
MIAVSNTGLVCGGRRSPHPAPCGSAQEGSFSPRALIPGRGGRRFRSSMAATEDERLAGSGEGERLDFLRDRHVRFFQRCLQVLPERYSSLETSRLTIAFFALSGLDMLDSLDVVNKDDIIEWIYSLQVLPTEDRSNLNRCGFRGSSYLGIPFNPSKAPGTAHPYDSGHIAMTYTGLSCLVILGDDLSRVNKEACLAGLRALQLEDGSFCAVPEGSENDMRFVYCASCICYMLNNWSGMDMKKAITYIRRSMSYDNGLAQGAGLESHGGSTFCGIASLCLMGKLEEVFSEKELNRIKRWCIMRQQNGYHGRPNKPVDTCYSFWVGATLKLLKIFQYTNFEKNRNYILSTQDRLVGGFAKWPDSHPDALHAYFGICGLSLMEESGICKVHPALNVSTRTSERLLDLHQSWKTKDSKQCSENVESYNQISC

SEQ ID NO: 819688 - protein, 638 aa, Homo sapiens
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSTGDSLRLEDGQAVQLEDGTTAFIHHTSKDSYDQSALQAVQLEDGTTAYIHHAVQVPQSDTILAIQADGTVAGLHTGDATIDPDTISALEQYAAKVSIDGSESVAGTGMIGENEQEKKMQIVLQGHATRVTAKSQQSGEKAFRCEYDGCGKLYTTAHHLKVHERSHTGDRPYQCEHAGCGKAFATGYGLKSHVRTHTGEKPYRCSEDNCTKSFKTSGDLQKHIRTHTGERPFKCPFEGCGRSFTTSNIRKVHVRTHTGERPYYCTEPGCGRAFASATNYKNHVRIHTGEKPYVCTVPGCDKRFTEYSSLYKHHVVHTHSKPYNCNHCGKTYKQISTLAMHKRTAHNDTEPIEEEQEAFFEPPPGQGEDVLKGSQITYVTGVEGDDVVSTQVATVTQSGLSQQVTLISQDGTQHVNISQADMQAIGNTITMVTQDGTPITVPAHDAVISSAGTHSVAMVTAEGTEGQQVAIVAQDLAAFHTASSEMGHQQHSHHLVTTETRPLTLVATSNGTQIAVQLGEQPSLEEAIRIASRIQQGETPGLDD

SEQ ID NO: 819689 - protein, 638 aa, Homo sapiens; identical to SEQ ID NO: 819688

SEQ ID NO: 819690 - protein, 638 aa, Homo sapiens; identical to SEQ ID NO: 819688

SEQ ID NO: 819691 - protein, 638 aa, Homo sapiens; identical to SEQ ID NO: 819688

SEQ ID NO: 819692 - protein, 638 aa, Homo sapiens; identical to SEQ ID NO: 819688

SEQ ID NO: 819693 - protein, 638 aa, Homo sapiens; identical to SEQ ID NO: 819688

SEQ ID NO: 819694 - protein, 607 aa, Homo sapiens [sequence omitted]

SEQ ID NO: 819695 - protein, 638 aa, Homo sapiens; identical to SEQ ID NO: 819688

SEQ ID NO: 819696 - protein, 205 aa, Homo sapiens
MHKRTAHNDTEPIEEEQEAFFEPPPGQGEDVLKGSQITYVTGVEGDDVVSTQVATVTQSGLSQQVTLISQDGTQHVNISQADMQAIGNTITMVTQDGTPITVPAHDAVISSAGTHSVAMVTAEGTEGQQVAIVAQDLAAFHTASSEMGHQQHSHHLVTTETRPLTLVATSNGTQIAVQLGEQPSLEEAIRIASRIQQGETPGLDD

SEQ ID NO: 819697 - protein, 364 aa, Homo sapiens
TCPGSSTATVSVFRISGSSPSVNTNAPPLPSSSTPTSPTNPCQGTVFKSSKNWRKRNANTLRKSALRSLLCELAKLFLKLYHIRTGPPGCGRAFASATNYKNHVRIHTGEKPYVCTVPGCDKRFTEYSSLYKHHVVHTHSKPYNCNHCGKTYKQISTLAMHKRTAHNDTEPIEEEQEAFFEPPPGQGEDVLKGSQITYVTGVEGDDVVSTQVATVTQSGLSQQVTLISQDGTQHVNISQADMQAIGNTITMVTQDGTPITVPAHDAVISSAGTHSVAMVTAEGTEGQQVAIVAQDLAAFHTASSEMGHQQHSHHLVTTETRPLTLVATSNGTQIAVQLGEQPSLEEAIRIASRIQQGETPGLDD

SEQ ID NO: 819698 - protein, 129 aa, Homo sapiens
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENFRLLGNVLVCVLARNFGKEFTPQMQA

SEQ ID NO: 819699 - protein, 141 aa, Homo sapiens
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENFRVCKKVPEALQIGSTCLFYKEYMGKEKSKGTVQGING

SEQ ID NO: 819700 - protein, 55 aa, Homo sapiens
MVHLTPEEKTAVNALWGKVNVDAVGGEALGSSWAMCWCVCWPATLARNSPHKCRL

SEQ ID NO: 819701 - protein, 700 aa, Homo sapiens
MADAGIRRVVPSDLYPLVLGFLRDNQLSEVANKFAKATGATQQDANASSLLDIYSFWLNRSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKTVPKKQVVAKAPVKAATTPTRKSSSSEDSSSDEEEEQKKPMKNKPGPYSSVPPPSAPPPKKSLGTQPPKKAVEKQQPVESSEDSSDESDSSSEEEKKPPTKAVVSKATTKPPPAKKAAESSSDSSDSDSSEDDEAPSKPAGTTKNSSNKPAVTTKSPAVKPAAAPKQPVGGGQKLLTRKADSSSSEEESSSSEEEKTKKMVATTKPKATAKAALSLPAKQAPQGSRDSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 819702 - protein, 155 aa, Homo sapiens
MADAGIRRVVPSDLYPLVLGFLRDNQLSEVANKFAKATGATQQDANASSLLDIYSFWLNRSAKVPERKLQANGPVAKKAKKKASSSDSEDSSEEEEEVQGPPAKKAAAPATPFALASAYAPPLSPTHAPFLPVSRSTLSQRSLPLLTASHRPFRP

SEQ ID NO: 819703 - protein, 700 aa, Homo sapiens; identical to SEQ ID NO: 819701

SEQ ID NO: 819704 - protein, 710 aa, Homo sapiens
MADAGIRRVVPSDLYPLVLGFLRDNQLSEVANKFAKATGATQQDANASSLLDIYSFWLNRSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKVWTITSVRAETVPKKQVVAKAPVKAATTPTRKSSSSEDSSSDEEEEQKKPMKNKPGPYSSVPPPSAPPPKKSLGTQPPKKAVEKQQPVESSEDSSDESDSSSEEEKKPPTKAVVSKATTKPPPAKKAAESSSDSSDSDSSEDDEAPSKPAGTTKNSSNKPAVTTKSPAVKPAAAPKQPVGGGQKLLTRKADSSSSEEESSSSEEEKTKKMVATTKPKATAKAALSLPAKQAPQGSRDSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 819705 - protein, 308 aa, Homo sapiens
MADAGIRRVVPSDLYPLVLGFLRDNQLSEVANKFAKATGATQQDANASSLLDIYSFWLNRSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKTVPKKQVVAKAPVKAATTPTRKSSSSEDSSSDEEEEQKKPMKNKPEVSGNPASQEGCGEAAACGKQ

SEQ ID NO: 819706 - protein, 418 aa, Homo sapiens [sequence omitted]

SEQ ID NO: 819707 - protein, 648 aa, Homo sapiens
MVQSTSARSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKTVPKKQVVAKAPVKAATTPTRKSSSSEDSSSDEEEEQKKPMKNKPGPYSSVPPPSAPPPKKSLGTQPPKKAVEKQQPVESSEDSSDESDSSSEEEKKPPTKAVVSKATTKPPPAKKAAESSSDSSDSDSSEDDEAPSKPAGTTKNSSNKPAVTTKSPAVKPAAAPKQPVGGGQKLLTRKADSSSSEEESSSSEEEKTKKMVATTKPKATAKAALSLPAKQAPQGSRDSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 819708 - protein, 418 aa, Homo sapiens [sequence omitted]

SEQ ID NO: 819709 - protein, 586 aa, Homo sapiens
RRLLWPVEKQQPVESSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKTVPKKQVVAKAPVKAATTPTRKSSSSEDSSSDEEEEQKKPMKNKPGPYSSVPPPSAPPPKKSLGTQPPKKAVEKQQPVESSEDSSDESDSSSEEEKKPPTKAVVSKATTKPPPAKKAAESSSDSSDSDSSEDDEAPSKPAGTTKNSSNKPAVTTKSPAVKPAAAPKQPVGGGQKLLTRKADSSSSEEESSSSEEEKTKKMVATTKPKATAKAALSLPAKQAPQGSRDSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 819710 - protein, 529 aa, Homo sapiens
MADAGIRRVVPSDLYPLVLGFLRDNQLSEVANKFAKATGATQQDANASSLLDIYSFWLNRSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQNSDSSEDDEAPSKPAGTTKNSSNKPAVTTKSPAVKPAAAPKQPVGGGQKLLTRKADSSSSEEESSSSEEEKTKKMVATTKPKATAKAALSLPAKQAPQGSRDSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 819711 - protein, 555 aa, Homo sapiens
MADAGIRRVVPSDLYPLVLGFLRDNQLSEVANKFAKATGAKGVKPQAKAAKAPPKKAKSSDSDSDSSSEDEPPKNQKPKITPVTVKAQTKAPPKPARAAPKIANGKAASSSSSSSSSSSSDDSEEEKAAATPKKTVPKKQVVAKAPVKAATTPTRKSSSSEDSSSDEEEEQKKPMKNKPGPYSSVPPPSAPPPKKSLGTQPPKKAVEKQQPVESSEDSSDESDSDSSEDDEAPSKPAGTTKNSSNKPAVTTKSPAVKPAAAPKQPVGGGQKLLTRKADSSSSEEESSSSEEEKTKKMVATTKPKATAKAALSLPAKQAPQGSRDSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 819712 - protein, 700 aa, Homo sapiens; identical to SEQ ID NO: 819701

SEQ ID NO: 819713 - protein, 700 aa, Homo sapiens; identical to SEQ ID NO: 819701

SEQ ID NO: 819714 - protein, 700 aa, Homo sapiens; identical to SEQ ID NO: 819701

SEQ ID NO: 819715 - protein, 288 aa, Homo sapiens
LSGHLLLKQSGPTQPERTAFLSNPQPLIFANLKHYQKQQSLPSLCSTSDPDTPLGAPSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 819716 - protein, 700 aa, Homo sapiens; identical to SEQ ID NO: 819701

SEQ ID NO: 819717 - protein, 700 aa, Homo sapiens; identical to SEQ ID NO: 819701

SEQ ID NO: 819718 - protein, 173 aa, Homo sapiens
MHELTKGMSYDNVEKRFKDRLLEYSNVKKNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 819719 - protein, 700 aa, Homo sapiens; identical to SEQ ID NO: 819701

SEQ ID NO: 819720 - protein, 700 aa, Homo sapiens; identical to SEQ ID NO: 819701

SEQ ID NO: 819721 - protein, 360 aa, Homo sapiens
MADAGIRRVVPSDLYPLVLGFLRDNQLSEVANKFAKATGATQQDANASSLLDIYSFWLNRSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKTVPKKQVVAKAPVKAATTPTRKSSSSEDSSSDEEEEQKKPMKNKPGPYSSVPPPSAPPPKKSLGTQPPKKAVEKQQPVESSEDSSDESDFLFYTSFPEVSSPVLCCCCCAGAGCCWHL

SEQ ID NO: 819722 - protein, 288 aa, Homo sapiens
MADAGIRRVVPSDLYPLVLGFLRDNQLSEVANKFAKATGATQQDANASSLLDIYSFWLNRSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKTVPKKQVVAKAPVKAATTPTRKSSSSEDSSSDEEEEQKKPMKNKPA

SEQ ID NO: 819723 - protein, 1815 aa, Homo sapiens
AANMAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQSTSEDKEKQYTSQTTRLLALLDALASHKACKLAILHLINGTIKGDERYAEIFQDLLALVRSPGDSVIRQQCVEYVTSILQSLCDQDIALILPSSSEGSISELEQLSNSLPNKELMTSICDCLLATLANSESSYNCLLTCVRTMMFLAEHDYGLFHLKSSLRKNSSALHSLLKRVVSTFSKDTGELASSFLEFMRQILNSDTIGCCGDDNGLMEVEGAHTSRTMSINAAELKQLLQSKEESPENLFLELEKLVLEHSKDDDNLDSLLDSVVGLKQMLESSGDPLPLSDQDVEPVLSAPESLQNLFNNRTAYVLADVMDDQLKSMWFTPFQAEEIDTDLDLVKVDLIELSEKCCSDFDLHSELERSFLSEPSSPGRTKTTKGFKLGKHKHETFITSSGKSEYIEPAKRAHVVPPPRGRGRGGFGQGIRPHDIFRQRKQNTSRPPSMHVDDFVAAESKEVVPQDGIPPPKRPLKVSQKISSRGGFSGNRGGRGAFHSQNRFFTPPASKGNYSRREGTRGSSWSAQNTPRGNYNESRGGQSNFNRGPLPPLRPLSSTGYRPSPRDRASRGRGGLGPSWASANSGSGGSRGKFVSGGSGRGRHVRSFTR

SEQ ID NO: 819724 - protein, 1759 aa, Homo sapiens
AANMAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKLMGRKKISLMEALQDHSQGDQELLQDPLHLMMMKMILCLCQCLVTRKRMLLIEKITLSPFLLIGILFPRKGNILMKEKYEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQSTSEDKEKQYTSQTTRLLALLDALASHKACKLAILHLINGTIKGDERYAEIFQDLLALVRSPGDSVIRQQCVEYVTSILQSLCDQDIALILPSSSEGSISELEQLSNSLPNKELMTSICDCLLATLANSESSYNCLLTCVRTMMFLAEHDYGLFHLKSSLRKNSSALHSLLKRVVSTFSKDTGELASSFLEFMRQILNSDTIGCCGDDNGLMEVEGAHTSRTMSINAAELKQLLQSKEESPENLFLELEKLVLEHSKDDDNLDSLLDSVVGLKQMLESSGDPLPLSDQDVEPVLSAPESLQNLFNNRTAYVLADVMDDQLKSMWFTPFQAEEIDTDLDLVKVDLIELSEKCCSDFDLHSELERSFLSEPSSPGRTKTTKGFKLGKHKHETFITSSGKSEYIEPAKRAHVVPPPRGRGRGGFGQGIRPHDIFRQRKQNTSRPPSMHVDDFVAAESKEVVPQDGIPPPKRPLKVSQKISSRGGFSGNRGGRGAFHSQNRFFTPPASKGNYSRREGTRGSSWSAQNTPRGNYNESRGGQSNFNRGPLPPLRPLSSTGYRPSPRDRASRGRGGLGPSWASANSGSGGSRGKFVSGGSGRGRHVRSFTR

SEQ ID NO: 819725 - protein, 1797 aa, Homo sapiens
AANMAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQSTSEDKEKQYTSQTTRLLALLDALASHKACKLAILHLINGTIKGDERYAEIFQDLLALVRSPGDSVIRQQCVEYVTSILQSLCDQDIALILPSSSEGSISELEQLSNSLPNKELMTSICDCLLATLANSESSYNCLLTCVRTMMFLAEHDYGLFHLKSSLRKNSSALHSLLKRVVSTFSKDTGELASSFLEFMRQILNSDTIGCCGDDNGLMEVEGAHTSRTMSINAAELKQLLQSKEESPENLFLELEKLVLEHSKDDDNLDSLLDSVVGLKQMLESSGDPLPLSDQDVEPVLSAPESLQNLFNNRTAYVLADVMDDQLKSMWFTPFQAEEIDTDLDLVKVDLIELSEKCCSDFDLHSELERSFLSEPSSPGRTKTTKGFKLGKHKHETFITSSGKSEYIEPAKRAHVVPPPRGRGRGGFGQGIRPHDIFRQRKQNTSRPPSMHVDDFVAAESKEVVPQDGIPPPKRPLKVSQKISSRGGFSGNRGGRGAFHSQNRFFTPPASKGNYSRREGTRGSSWSAQNTPRGNYNESRGGQSNFNRGPLPPLRPLSSTGYRPSPRDRASRGRGGLGPSWASANSGSGGSRGKFVSGGSGRGRHVRSFTR

SEQ ID NO: 819726 - protein, 1815 aa, Homo sapiens; identical to SEQ ID NO: 819723

SEQ ID NO: 819727 - protein, 1724 aa, Homo sapiens
AANMAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQSTSEDKEKQYTSQTTRLLALLDALASHKACKLAILHLINGTIKGDERYAEIFQDLLALVRSPGDSVIRQQCVEYVTSILQSLCDQDIALILPSSSEGSISELEQLSNSLPNKELMTSICDCLLATLANSESSYNCLLTCVRTMMFLAEHDYGLFHLKSSLRKNSSALHSLLKRVVSTFSKDTGELASSFLEFMRQILNSDTIGCCGDDNGLMEVEGAHTSRTMSINAAELKQLLQSKEESPENLFLELEKLVLEHSKDDDNLDSLLDSVVGLKQMLESSGDPLPLSDQDVEPVLSAPESLQNLFNNRTAYVLADVMDDQLKSMWFTPFQAEEIDTDLDLVKVDLIELSEKCCSDFDLHSELERSFLSEPSSPGRTKTTKGFKLGKHKHETFITSSGKSEYIEPAKRAHVVPPPRGRGRGGFGQGIRPHDIFRQRKQNTSRPPSMHVDDFVAAESKEVVPQDGIPPPKRPLKVSQKISSRGGFSGNRGGRGAFHSQNRFFTPPASKEYSSRKLQ

SEQ ID NO: 819728 - protein, 1490 aa, Homo sapiens
AANMAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQSTSEDKEKQYTSQTTRLLALLDALASHKACKLAILHLINGTIKGDERYAEIFQDLLALVRSPGDSVIRQQCVEYVTSILQSLCDQDIALILPSSSEGSISELEQLSNSLPNKELMTSICDCLLATLANSESSYNCLLTCVRTMMFLAEHDYGLFHLKSSLRKNSSALHSLLKRVVSTFSKDTGELASSFLEFMRQILNSDTIGCCGDDNGLMEVEGAHTSRTMSINAAELKQLLQSKEESPENLFLELEKLVLEHSKDDDNLDSLLDSVESERDPLDPR

SEQ ID NO: 819729 - protein, 1226 aa, Homo sapiens
AANMAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQRYFHFALKIFSSNYF

SEQ ID NO: 819730 - protein, 1212 aa, Homo sapiens
AANMAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQS

SEQ ID NO: 819731 - protein, 1800 aa, Homo sapiens
AANMAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQSTSEDKEKQYTSQTTRLLALLDALASHKACKLAILHLINGTIKGDERYAEIFQDLLALVRSPGDSVIRQQCVEYVTSILQSLCDQDIALILPSSSEGSISELEQLSNSLPNKELMTSICDCLLATLANSESSYNCLLTCVRTMMFLAEHDYGLFHLKSSLRKNSSALHSLLKRVVSTFSKDTGELASSFLEFMRQILNSDTIGCCGDDNGLMEVEGAHTSRTMSINAAELKQLLQSKEESPENLFLELEKLVLEHSKDDDNLDSLLDSVVGLKQMLESSGDPLPLSDQDVEPVLSAPESLQNLFNNRTAYVLADVMDDQLKSMWFTPFQAEEIDTDLDLVKVDLIELSEKCCSDFDLHSELERSFLSEPSSPGRTKTTKGFKLGKHKHETFITSSGKSEYIEPAKRAHVVPPPRGRGRGGFGQGIRPHDIFRQRKQNTSRPPSMHVDDFVAAESKEVVPQDGIPPPKRPLKVSQKEQEAPVGVLRILLEEITMKVVEARAILTEALFHHYDPLVLQVTAQVLGTVLLEVVGDLDLPGLVQIAAVEAQEESLLVEAVVEVVMYAPLHDKNPFGNILTVYEHFTRTIKIRH

SEQ ID NO: 819732 - protein, 1757 aa, Homo sapiens
MIEFGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQSTSEDKEKQYTSQTTRLLALLDALASHKACKLAILHLINGTIKGDERYAEIFQDLLALVRSPGDSVIRQQCVEYVTSILQSLCDQDIALILPSSSEGSISELEQLSNSLPNKELMTSICDCLLATLANSESSYNCLLTCVRTMMFLAEHDYGLFHLKSSLRKNSSALHSLLKRVVSTFSKDTGELASSFLEFMRQILNSDTIGCCGDDNGLMEVEGAHTSRTMSINAAELKQLLQSKEESPENLFLELEKLVLEHSKDDDNLDSLLDSVVGLKQMLESSGDPLPLSDQDVEPVLSAPESLQNLFNNRTAYVLADVMDDQLKSMWFTPFQAEEIDTDLDLVKVDLIELSEKCCSDFDLHSELERSFLSEPSSPGRTKTTKGFKLGKHKHETFITSSGKSEYIEPAKRAHVVPPPRGRGRGGFGQGIRPHDIFRQRKQNTSRPPSMHVDDFVAAESKEVVPQDGIPPPKRPLKVSQKISSRGGFSGNRGGRGAFHSQNRFFTPPASKGNYSRREGTRGSSWSAQNTPRGNYNESRGGQSNFNRGPLPPLRPLSSTGYRPSPRDRASRGRGGLGPSWASANSGSGGSRGKFVSGGSGRGRHVRSFTR

SEQ ID NO: 819733 - protein, 1797 aa, Homo sapiens
AANMAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQSTSEDKEKQYTSQTTRLLALLDALASHKACKLAILHLINGTIKGDERYAEIFQDLLALVRSPGDSVIRQQCVEYVTSILQSLCDQDIALILPSSSEGSISELEQLSNSLPNKELMTSICDCLLATLANSESSYNCLLTCVRTMMFLAEHDYGLFHLKSTFSKDTGELASSFLEFMRQILNSDTIGCCGDDNGLMEVEGAHTSRTMSINAAELKQLLQSKEESPENLFLELEKLVLEHSKDDDNLDSLLDSVVGLKQMLESSGDPLPLSDQDVEPVLSAPESLQNLFNNRTAYVLADVMDDQLKSMWFTPFQAEEIDTDLDLVKVDLIELSEKCCSDFDLHSELERSFLSEPSSPGRTKTTKGFKLGKHKHETFITSSGKSEYIEPAKRAHVVPPPRGRGRGGFGQGIRPHDIFRQRKQNTSRPPSMHVDDFVAAESKEVVPQDGIPPPKRPLKVSQKISSRGGFSGNRGGRGAFHSQNRFFTPPASKGNYSRREGTRGSSWSAQNTPRGNYNESRGGQSNFNRGPLPPLRPLSSTGYRPSPRDRASRGRGGLGPSWASANSGSGGSRGKFVSGGSGRGRHVRSFTR

SEQ ID NO: 819734 - protein, 1630 aa, Homo sapiens
AANMAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVIEPHDISVALNTRKLWSMHLHVQAKLLQEIVRSFSGTTCQPIQHMLRRICVQLCDLASPTALLIMRTVLDLIVEDLQSTSEDKEKQYTSQTTRLLALLDALASHKACKLAILHLINGTIKGDERYAEIFQDLLALVRSPGDSVIRQQCVEYVTSILQSLCDQDIALILPSSSEGSISELEQLSNSLPNKELMTSICDCLLATLANSESSYNCLLTCVRTMMFLAEHDYGLFHLKSSLRKNSSALHSLLKRVVSTFSKDTGELASSFLEFMRQILNSDTIGCCGDDNGLMEVEGAHTSRTMSINAAELKQLLQSKEESPENLFLELEKLVLEHSKDDDNLDSLLDSVVGLKQMLESSGDPLPLSDQDVEPVLSAPESLQNLFNNRTAYVLADVMDDQLKSMWFTPFQAEEIDTDLDLVKVDLIELSEKCCSDFDLHSELERSFLSEPSSPGRTKTTKGFKLGKHKHETFITSRKLQSSGRNKRLQLECSEYSSRKLQ

SEQ ID NO: 819735 - protein, 259 aa, Homo sapiens
SSGKSEYIDVIKVLMLVLPKFETFITSVENLNTLNLPKELMLCHHQEEGAGEDLDRVYDLMIFFVRENRTQVDHHLCMWMTLLLLKVKKWFLKMEYLHQNGHSKYHRRFLPVVGFQAIEEDGVLSTVRIGFSHHLLQKETTVVGKEQEAPVGVLRILLEEITMKVVEARAILTEALFHHYDPLVLQVTAQVLGTVLLEVVGDLDLPGLVQIAAVEAQEESLLVEAVVEVVMYAPLHDKNPFGNILTVYEHFTRTIKIRH

SEQ ID NO: 819736 - protein, 1150 aa, Homo sapiens
AANMAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISSDEDGIADLERETFKYPNFDVEYTAEDLASVPPMTYDPYDRELVPLLYFSCPYKTTFEIEISRMKDQGPDKENSGAIEASVKLTELLDLYREDRGAKWVTALEEIPSLIIKGLSYLQLKNTKQDSLGQLVDWTMQALNLQVALRQPIALNVRQLKAGTKLVSSLAECGAQGVTGLLQAGVISGLFELLFADHVSSSLKLNAFKALDSVISMTEGMEAFLRGRQNEKSGYQKLLELILLDQTVRVVTAGSAILQKCHFYEVLSEIKRLGDHLAEKTSSLPNHSEPDHDTDAGLERTNPEYENEVEASMDMDLLESSNISEGEIERLINLLEEVFHLMETAPHTMIQQPVKSFPTMARITGPPERDDPYPVLFRYLHSHHFLELVTLLLSIPVTSAHPGVLQATKDVLKFLAQSQKGLLFFMSEYEATNLLIRALCHFYDQDEEEGLQSDGVIDDAFALWLQDSTQTLQCITELFSHFQRCTASEETDHSDLLGTLHNLYLITFNPVGRSAVGHVFSLEKNLQSLITLMEYYSKEALGDSKSKKSVAYNYACILILVVVQSSSDVQMLEQHAASLLKLCKADENNAKLQELGKWLEPLKNLRFEINCIPNLIEYVKQNIDNLMTPEGVGLTTALRVLCNVACPPPPVEGQQKDLKWNLAVIQLFSAEGMDTFIRVLQKLNSILTQPWRLHVNMGTTLHRVTTISMARCTLTLLKTMLTELLRGGSFEFKDMRVPSALVTLHMLLCSIPLSGRLDSDEQKIQNDIIDILLTFTQGVNEKLTISEETLANNTWSLMLKEVLSSILKVPEGFFSGLILLSELLPLPLPMQTTQVSLPYNMHLINDCSNTF

SEQ ID NO: 819737 - protein, 307 aa, Homo sapiens
AANMAVDSAMELLFLDTFKHPSAEQSSHIDVVRFPCVVYINEVRVIPPGVRAHSSLPDNRAYGETSPHTFQLDLFFNNVSKPSAPVFDRLGSLEYDENTSIIFRPNSKVNTDGLVLRGWYNCLTLAIYGSVDRVISHDRDSPPPPPPPPPPPQPQPSLKRNPKHADGEKEDQFNGSPPRPQPRGPRTPPGPPPPDDDEDDPVPLPVSGDKEEDAPHREDYFEPISPDRNSVPQEGQYSDEGEVEEEQQEEGEEDEDDVDVEEEEDEDEDDRRTVDSIPEEEEEDEEEEGEEDEEGEGDDGYEQISRD

SEQ ID NO: 819738 - protein, 405 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 819739 - protein, 224 aa, Homo sapiens
MVPSTQHTANGPMAPISCGICHQNTTSSAPGCPGYHQNTPCAQQHLLLCTPGSFSRGSGRGSTENMESHLALIDAIAKGEDSRHPLSGARVPGSHQEEDLSSTVRHISVFPAASTTTLSFQSRSASGKPSLCPPPSGVASMSVSPKVMEHRAPPGKVPSPPAPRVPALSLTAVTHSVSAEATGQVCHALCSPEGCWGPEPRDCVSCRNVSRGRECVDKCNLLEG

SEQ ID NO: 819740 - protein, 304 aa, Homo sapiens
MYELGVNSAGLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGPGPQGELIRGSG

SEQ ID NO: 819741 - protein, 76 aa, Homo sapiens
MHLPSPTDSNFYRALMDEEDMDDVVDADEYLIPQQGFFSSPLTSHYYRLHPQAHNLYPYYYRPYPQYHMAQVQTTT

SEQ ID NO: 819742 - protein, 140 aa, Homo sapiens
GSSSTASHSPGQSTAYPGAVGPHVPPQAARPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 819743 - protein, 1025 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQVQIAVCASIGKSPSNEHLMSLCSVTCQPGLPVSQIALLNPPAH

SEQ ID NO: 819744 - protein, 705 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 819745 - protein, 657 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGSYIVSHFPRSFYKMSVH

SEQ ID NO: 819746 - protein, 350 aa, Homo sapiens [sequence omitted]

SEQ ID NO: 819747 - protein, 350 aa, Homo sapiens [sequence omitted]

SEQ ID NO: 819748 - protein, 350 aa, Homo sapiens [sequence omitted]

SEQ ID NO: 819749 - protein, 385 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHIRTGPRASTDVGGHI

SEQ ID NO: 819750 - protein, 215 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCKCRIHTISASSSYGGQLYSTGAGERSHV

SEQ ID NO: 819751 - protein, 215 aa, Homo sapiens; identical to SEQ ID NO: 819750

SEQ ID NO: 819752 - protein, 1590 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 819753 - protein, 132 aa, Homo sapiens
MEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKVRILVVVAESRVYGQG

SEQ ID NO: 819754 - protein, 1563 aa, Homo sapiens
MPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 819755 - protein, 1563 aa, Homo sapiens; identical to SEQ ID NO: 819754

SEQ ID NO: 819756 - protein, 1563 aa, Homo sapiens; identical to SEQ ID NO: 819754

SEQ ID NO: 819757 - protein, 1563 aa, Homo sapiens; identical to SEQ ID NO: 819754

SEQ ID NO: 819758 - protein, 1563 aa, Homo sapiens; identical to SEQ ID NO: 819754

SEQ ID NO: 819759 - protein, 1572 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 819760 - protein, 1487 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQPRGSFSQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 819761 - protein, 1140 aa, Homo sapiens
LRGHILGFSNKDNQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 819762 - protein, 1496 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 819763 - protein, 370 aa, Homo sapiens
MFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 819764 - protein, 1499 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKKKKKKKKKT

SEQ ID NO: 819765 - protein, 276 aa, Homo sapiens
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 819766 - protein, 236 aa, Homo sapiens
MEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 819767 - protein, 236 aa, Homo sapiens; identical to SEQ ID NO: 819766

SEQ ID NO: 819768 - protein, 254 aa, Homo sapiens
MCLLCFQRTAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 819769 - protein, 254 aa, Homo sapiens
MEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 819770 - protein, 266 aa, Homo sapiens
MWLAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 819771 - protein, 202 aa, Homo sapiens
TYKRVGCRRGTKGVAPKLTISQVMGKKKETSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 819772 - protein, 1386 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRSLLQVESAGRQKCRSLKRHLKTPILGSTIVILSTGVTGEVTNLVTSGKNTWLLFHLHTS

SEQ ID NO: 819773 - protein, 1170 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQVCMSHSGAQASLWRATKR

SEQ ID NO: 819774 - protein, 244 aa, Homo sapiens
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEGKPRHSGPV

SEQ ID NO: 819775 - protein, 110 aa, Homo sapiens
GSPRPSSSCSRSRAASAPSRNRKAWTPWKFCKSGNTGNAPRQQGAPCGVLAPAAQAEGGEAPASLVGQTVIFTRAVGKLSSTPGAFPVLRGGTGVLKIKSRRGLPVDPRE

SEQ ID NO: 819776 - protein, 1021 aa, Homo sapiens
MATEGAAQLGNRVAGMVCSLWVLLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKRWTKVDTIAADESFPSSSSSSSSSSSAAWAVGPHGAGQRAGLQLNVKERSFGPLTQRGFYVAFQDTGACLALVAVRLFSYTCPAVLRSFASFPETQASGAGGASLVAAVGTCVAHAEPEEDGVGGQAGGSPPRLHCNGEGKWMVAVGGCRCQPGYQPARGDKACQACPRGLYKSSAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 819777 - protein, 129 aa, Homo sapiens
YRIRTIPSELPLEEQTESRVRRLAADPGSRLGQGFHTGGGTRDPAWRRRSRRGPPGSPGAPPLEQPLPPASGPPRNPRDSRRRTDPGRVQRGPRTGEDAGGTVRAPGAPGPLRGLGGRRPAETAANGKK

SEQ ID NO: 819778 - protein, 932 aa, Homo sapiens
MATEGAAQLGNRVAGMVCSLWVLLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKTLDQETQASGAGGASLVAAVGTCVAHAEPEEDGVGGQAGGSPPRLHCNGEGKWMVAVGGCRCQPGYQPARGDKACQACPRGLYKSSAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 819779 - protein, 705 aa, Homo sapiens
GQALKPGQALKPGQALKPGQALKPGQALKPGQALKPGQALKPGQALKPGQALRPGQALKPGQALKPGQALKAWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 819780 - protein, 756 aa, Homo sapiens
MATEGAAQLGNRVAGMVCSLWVLLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKRWTKVDTIAADESFPSSSSSSSSSSSAAWAVGPHGAGQRAGLQLNVKERSFGPLTQRGFYVAFQDTGACLALVAVRLFSYTCPAVLRSFASFPETQASGAGGASLVAAVGTCVAHAEPEEDGVGGQAGGSPPRLHCNGEGKWMVAVGGCRCQPGYQPARGDKACQACPRGLYKSSAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVLRLSTSPLLIKGKEGNLQ

SEQ ID NO: 819781 - protein, 129 aa, Homo sapiens; identical to SEQ ID NO: 819777

SEQ ID NO: 819782 - protein, 1175 aa, Homo sapiens
MPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 819783 - protein, 1301 aa, Homo sapiens
MPKKKRLSAGRVPLILFLCQMISALEVPLDRKYERFKDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 819784 - protein, 1301 aa, Homo sapiens; identical to SEQ ID NO: 819783

SEQ ID NO: 819785 - protein, 1301 aa, Homo sapiens; identical to SEQ ID NO: 819783

SEQ ID NO: 819786 - protein, 1301 aa, Homo sapiens; identical to SEQ ID NO: 819783

SEQ ID NO: 819787 - protein, 1169 aa, Homo sapiens
MPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 819788 - protein, 943 aa, Homo sapiens
MPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTRVHLKVSAN

SEQ ID NO: 819789 - protein, 537 aa, Homo sapiens
MTGVPAGDDNRYVPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 819790 - protein, 1301 aa, Homo sapiens; identical to SEQ ID NO: 819783

SEQ ID NO: 819791 - protein, 376 aa, Homo sapiens
MPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIESKLP

SEQ ID NO: 819792 - protein, 72 aa, Homo sapiens
WKTQSSSKRNRRHIEKKILTFQGSKTHGMLPGLEPFSHYTLNVRVVNGKGEGPASPDRVFNTPEGGMEWTCL

SEQ ID NO: 819793 - protein, 153 aa, Homo sapiens
MAPAAATGGSTLPSGFSVFTTLPDLLFIFEFIFGGLVWILVASSLVPWPLVQGWVMFVSVFCFVATTTLIILYIIGAHGGETSWVTLDAAYHCTAALFYLSASVLEALATITMQDGFTYRHYHENIAAVVFSYIATLLYVVHAVFSLIRWKSS

SEQ ID NO: 819794 - protein, 138 aa, Homo sapiens
MPLMVEKRKQPPPHCPKKKALPCCSWVLCLLSRVPSRPGWELAVSNLQLLCCLLGSPPVCERGPSCSGVGSGDRDLRRKERSSADPWSSSRELPVGIVHKLSRAPHLVPCFKSSWMFCMSWGLKLTQQIFPEVHGGRR

SEQ ID NO: 819795 - protein, 111 aa, Homo sapiens
MAPAAATGGSTLPSGFSVFTTLPDLLFIFEFIFGGLVWILVASSLVPWPLVQGWVMFVSVFCFVATTTLIILYIIGAHGGETSWVTLVFSYIATLLYVVHAVFSLIRWKSS

SEQ ID NO: 819796 - protein, 138 aa, Homo sapiens; identical to SEQ ID NO: 819794

SEQ ID NO: 819797 - protein, 205 aa, Homo sapiens
KVAESIQSRGLGESLKETLVQMLDGPSDDHCLHRGTPRLGSVVQRDEYKKRLRAGETLHRLCNKLDALRCALYRHLDVIHSGRALAVQSWMSHHLPWLPWPLVQGWVMFVSVFCFVATTTLIILYIIGAHGGETSWVTLDAAYHCTAALFYLSASVLEALATITMQDGFTYRHYHENIAAVVFSYIATLLYVVHAVFSLIRWKSS

SEQ ID NO: 819798 - protein, 153 aa, Homo sapiens; identical to SEQ ID NO: 819793

SEQ ID NO: 819799 - protein, 137 aa, Homo sapiens
SSVPPPSHRPPPHCPKKKALPCCSWVLCLLSRVPSRPGWELAVSNLQLLCCLLGSPPVCERGPSCSGVGSGDRDLRRKERSSADPWSSSRELPVGIVHKLSRAPHLVPCFKSSWMFCMSWGLKLTQQIFPEVHGGRR

SEQ ID NO: 819800 - protein, 97 aa, Homo sapiens
SVAMNREKLASRGNGLITNGSQVRQPRSKKPGDHEHHLRYTEQTVTFTVRPGTSQPITLQSRPPDYESRTSGTRRAPSPVVSPTEMNKETLPAPLSG

SEQ ID NO: 819801 - protein, 475 aa, Homo sapiens
ALKDSRRFLNHLNNRLGDQRRVYSFPCIAAFADEHEMRKPADEKLEKFWIDFNLGSQSVTFYIDNAENTLWDSVTLPKEAVMNFSITETEKIKIFIIYLKKPMIISYKEVMKIEIHFDLQFNISQVSIQALGEDKQMLPDQTKISSELFSKSDKEDRESPSGLERETEQAEESTNMVEFMSAEDDRCLITLHLNDQSEPPVIGEPASDSHLQPVPPFGVPDFPQQPKSHYRKHLFSESNQDSSTSELSWTSNQKKKSLKSYSSRKKTRTRSNLRILPVFPPSSGSGHEKDQAKLLSPSEKEIPEQNNTTSPKTSEQKFQDSFAFLTAEDSAQKTELQDPHSLSELSSLKHSEDEEKPKIVNQESLTESTSLKHKLRNLEDKDIPEGSFAKSQQSRLEEEVAPGSPFSITEERELPEGISTSSLEVVPENLNGSAILPTFENFTKKRKRKYELRYRKRPFNSENAKKAPDCLIKLF

SEQ ID NO: 819802 - protein, 475 aa, Homo sapiens; identical to SEQ ID NO: 819801

SEQ ID NO: 819803 - protein, 475 aa, Homo sapiens; identical to SEQ ID NO: 819801

SEQ ID NO: 819804 - protein, 192 aa, Homo sapiens
GVSFAAPRRHQLRGKMEALILEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 819805 - protein, 192 aa, Homo sapiens; identical to SEQ ID NO: 819804

SEQ ID NO: 819806 - protein, 192 aa, Homo sapiens; identical to SEQ ID NO: 819804

SEQ ID NO: 819807 - protein, 200 aa, Homo sapiens
DPRVRGRVVSTHASARRHQLRGKMEALILEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 819808 - protein, 192 aa, Homo sapiens; identical to SEQ ID NO: 819804

SEQ ID NO: 819809 - protein, 177 aa, Homo sapiens
MEALILEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 819810 - protein, 192 aa, Homo sapiens; identical to SEQ ID NO: 819804

SEQ ID NO: 819811 - protein, 178 aa, Homo sapiens
MSRKRDKEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 819812 - protein, 205 aa, Homo sapiens
QTFISEHHYCLWPWKLKWITEVNGTKGKMEALILEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 819813 - protein, 172 aa, Homo sapiens
MEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 819814 - protein, 182 aa, Homo sapiens
VPCIADRVLILEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 819815 - protein, 177 aa, Homo sapiens
MFVSLQEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 819816 - protein, 192 aa, Homo sapiens; identical to SEQ ID NO: 819804

SEQ ID NO: 819817 - protein, 125 aa, Homo sapiens
MEIDFLPSTMTTPTPVSRSKRPLRRTFSTRPIGLTLMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 819818 - protein, 192 aa, Homo sapiens; identical to SEQ ID NO: 819804

SEQ ID NO: 819819 - protein, 192 aa, Homo sapiens; identical to SEQ ID NO: 819804

SEQ ID NO: 819820 - protein, 173 aa, Homo sapiens
QTFISEHHYCLWPWKLKWITEVNGTKGKMEALILEPSLYTVKAILILDNDGDRLFAKYYDDTYPSVKEQKAFEKNIFNKTHRTDSEIALLEGLTVVYKSSIDLYFYVIGSSYENEGLFLAVDEIVDGGVILESDPQQVVHRVALRGEDVPLTEQTVSQVLQSAKEQIKWSLLR

SEQ ID NO: 819821 - protein, 192 aa, Homo sapiens; identical to SEQ ID NO: 819804

SEQ ID NO: 819822 - protein, 126 aa, Homo sapiens
ERIDDRFEDLLYQILVLRQVKFSVALVWNRLTSETDYKGLESSHTCLEMQYKTEDIADKWRKENGETSEYPHEKNEIVDGGVILESDPQQVVHRVALRGEDVPLTEQTVSQVLQSAKEQIKWSLLR

SEQ ID NO: 819823 - protein, 192 aa, Homo sapiens; identical to SEQ ID NO: 819804

SEQ ID NO: 819824 - protein, 177 aa, Homo sapiens
GVSFAAPRRHQLRGKMEALILEPSLYTVKAILILDNDGDRLFAKYYDDTYPSVKEQKAFEKNIFNKTHRTDSEIALLEGLTVVYKSSIDLYFYVIGSSYENELMLMAVLNCPLQKICMSAVNFHLVPQSMLSGSSRGSQGSLNLHSVCGCPLNLPYTLPILFHSSCSSGSKAPSIFR

SEQ ID NO: 819825 - protein, 192 aa, Homo sapiens; identical to SEQ ID NO: 819804

SEQ ID NO: 819826 - protein, 134 aa, Homo sapiens
GVSFAAPRRHQLRGKMEALILEPSLYTVKAILILDNDGDRLFAKLMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 819827 - protein, 343 aa, Homo sapiens
MASNSSDVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 819828 - protein, 322 aa, Homo sapiens
MGIVPLMNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 819829 - protein, 298 aa, Homo sapiens
TASPPRPLTPGLTLSVLLGGLADPAPPPIGGLAGRTPGPVQRLGQSDASARPAAASRASEWPRVRVKEFLAKAKEDFLKKWESPAQNTAHLDQFERIKTLGTGSFGRVMLVKHKETGNHYAMKILDKQKVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 819830 - protein, 99 aa, Homo sapiens
ERRGKQGLGGGRGAAASAASPRAAAAAAQRAPGPPAAASTRRAAAPGPAPAAAAAMGNAAAAKKGSEQESVKEFLAKAKEDFLKKWESPAQLPAHFCLF

SEQ ID NO: 819831 - protein, 343 aa, Homo sapiens; identical to SEQ ID NO: 819827

SEQ ID NO: 819832 - protein, 343 aa, Homo sapiens; identical to SEQ ID NO: 819827

SEQ ID NO: 819833 - protein, 343 aa, Homo sapiens; identical to SEQ ID NO: 819827

SEQ ID NO: 819834 - protein, 280 aa, Homo sapiens
MASNSSDVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRSGCGDTALEETDRSLLTHPIPWGALLVVRII

SEQ ID NO: 819835 - protein, 406 aa, Homo sapiens
ERRGKQGLGGGRGAAASAASPRAAAAAAQRAPGPPAAASTRRAAAPGPAPAAAAAMGNAAAAKKGSEQESVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 819836 - protein, 375 aa, Homo sapiens
MASNSSDVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKVGASPALPFSLRPALLSCSRLLLTLCPPILLQGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 819837 - protein, 240 aa, Homo sapiens
MASNSSDVKEFLAKAKEDFLKKWESPAQNTAHLDQFERIKTLGTGSFGRVMLVKHKETGNHYAMKILDKQKVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 819838 - protein, 343 aa, Homo sapiens; identical to SEQ ID NO: 819827

SEQ ID NO: 819839 - protein, 343 aa, Homo sapiens; identical to SEQ ID NO: 819827

SEQ ID NO: 819840 - protein, 216 aa, Homo sapiens
MASNSSDVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKVGASPALPFP

SEQ ID NO: 819841 - protein, 131 aa, Homo sapiens
CLFNFSSAAPSSRKRCLIPPSPDHARYFTWASWGLLLHNPKIPSTTALTSVGVTHVFFALDLVPCKDKQPLASLMLCPQHQLRARQATGTQMILAEGTGLAPASLVPGIRGNEAPLTSPSFLPSPPSLPRW

SEQ ID NO: 819842 - protein, 1008 aa, Homo sapiens
ALCNCGEPSLHGQRELRRFELPFDWPRCPVVSPGGSPGPNEAVLPSEDLSQIGFPEGLTPAHLGEPGGSCWAHHWCAAWSAGVWGQEGPELCGVDKAIFSGISQRCSHCTRLGASIPCRSPGCPRLYHFPCATASGSFLSMKTLQLLCPEHSEGAAYLEEARCAVCEGPGELCDLFFCTSCGHHYHGACLDTALTARKRAGWQCPECKVCQACRKPGNDSKMLVCETCDKGYHTFCLKPPMEELPAHSWKCKACRVCRACGAGSAELNPNSEWFENYSLCHRCHKAQGGQTIRSVAEQHTPVCSRFSPPEPGDTPTDEPDALYVACQGQPKGGHVTSMQPKEPGPLQCEAKPLGKAGVQLEPQLEAPLNEEMPLLPPPEESPLSPPPEESPTSPPPEASRLSPPPEELPASPLPEALHLSRPLEESPLSPPPEESPLSPPPESSPFSPLEESPLSPPEESPPSPALETPLSPPPEASPLSPPFEESPLSPPPEELPTSPPPEASRLSPPPEESPMSPPPEESPMSPPPEASRLFPPFEESPLSPPPEESPLSPPPEASRLSPPPEDSPMSPPPEESPMSPPPEVSRLSPLPVVSRLSPPPEESPLSPPPEESPTSPPPEASRLSPPPEDSPTSPPPEDSPASPPPEDSLMSLPLEESPLLPLPEEPQLCPRSEGPHLSPRPEEPHLSPRPEEPHLSPQAEEPHLSPQPEEPCLCAVPEEPHLSPQAEGPHLSPQPEELHLSPQTEEPHLSPVPEEPCLSPQPEESHLSPQSEEPCLSPRPEESHLSPELEKPPLSPRPEKPPEEPGQCPAPEELPLFPPPGEPSLSPLLGEPALSEPGEPPLSPLPEELPLSPSGEPSLSPQLMPPDPLPPPLSPIITAAAPPALSPLGELEYPFGAKGDSDPESPLAAPILETPISPPPEANCTDPEPVPPMILPPSPGSPVGPASPILMEPLPPQCSPLLQHSLVPQNSPPSQCSPPALPLSVPSPLSPIGKVVGVSDEAELHEME

SEQ ID NO: 819843 - protein, 756 aa, Homo sapiens
SWYRRSLCGAGSAELNPNSEWFENYSLCHRCHKAQGGQTIRSVAEQHTPVCSRFSPPEPGDTPTDEPDALYVACQGQPKGGHVTSMQPKEPGPLQCEAKPLGKAGVQLEPQLEAPLNEEMPLLPPPEESPLSPPPEESPTSPPPEASRLSPPPEELPASPLPEALHLSRPLEESPLSPPPEESPLSPPPESSPFSPLEESPLSPPEESPPSPALETPLSPPPEASPLSPPFEESPLSPPPEELPTSPPPEASRLSPPPEESPMSPPPEESPMSPPPEASRLFPPFEESPLSPPPEESPLSPPPEASRLSPPPEDSPMSPPPEESPMSPPPEVSRLSPLPVVSRLSPPPEESPLSPPPEESPTSPPPEASRLSPPPEDSPTSPPPEDSPASPPPEDSLMSLPLEESPLLPLPEEPQLCPRSEGPHLSPRPEEPHLSPRPEEPHLSPQAEEPHLSPQPEEPCLCAVPEEPHLSPQAEGPHLSPQPEELHLSPQTEEPHLSPVPEEPCLSPQPEESHLSPQSEEPCLSPRPEESHLSPELEKPPLSPRPEKPPEEPGQCPAPEELPLFPPPGEPSLSPLLGEPALSEPGEPPLSPLPEELPLSPSGEPSLSPQLMPPDPLPPPLSPIITAAAPPALSPLGELEYPFGAKGDSDPESPLAAPILETPISPPPEANCTDPEPVPPMILPPSPGSPVGPASPILMEPLPPQCSPLLQHSLVPQNSPPSQCSPPALPLSVPSPLSPIGKVVGVSDEAELHEME

SEQ ID NO: 819844 - protein, 787 aa, Homo sapiens
MLVCETCDKGYHTFCLKPPMEELPAHSWKCKACRVCRACGAGSAELNPNSEWFENYSLCHRCHKAQGGQTIRSVAEQHTPVCSRFSPPEPGDTPTDEPDALYVACQGQPKGGHVTSMQPKEPGPLQCEAKPLGKAGVQLEPQLEAPLNEEMPLLPPPEESPLSPPPEESPTSPPPEASRLSPPPEELPASPLPEALHLSRPLEESPLSPPPEESPLSPPPESSPFSPLEESPLSPPEESPPSPALETPLSPPPEASPLSPPFEESPLSPPPEELPTSPPPEASRLSPPPEESPMSPPPEESPMSPPPEASRLFPPFEESPLSPPPEESPLSPPPEASRLSPPPEDSPMSPPPEESPMSPPPEVSRLSPLPVVSRLSPPPEESPLSPPPEESPTSPPPEASRLSPPPEDSPTSPPPEDSPASPPPEDSLMSLPLEESPLLPLPEEPQLCPRSEGPHLSPRPEEPHLSPRPEEPHLSPQAEEPHLSPQPEEPCLCAVPEEPHLSPQAEGPHLSPQPEELHLSPQTEEPHLSPVPEEPCLSPQPEESHLSPQSEEPCLSPRPEESHLSPELEKPPLSPRPEKPPEEPGQCPAPEELPLFPPPGEPSLSPLLGEPALSEPGEPPLSPLPEELPLSPSGEPSLSPQLMPPDPLPPPLSPIITAAAPPALSPLGELEYPFGAKGDSDPESPLAAPILETPISPPPEANCTDPEPVPPMILPPSPGSPVGPASPILMEPLPPQCSPLLQHSLVPQNSPPSQCSPPALPLSVPSPLSPIGKVVGVSDEAELHEME

SEQ ID NO: 819845 - protein, 784 aa, Homo sapiens
ALCNCGEPSLHGQRELRRFELPFDWPRCPVVSPGGSPGPNEAVLPSEDLSQIGFPEGLTPAHLGEPGGSCWAHHWCAAWSAGVWGQEGPELCGVDKAIFSGISQRCSHCTRLGASIPCRSPGCPRLYHFPCATASGSFLSMKTLQLLCPEHSEGAAYLEEARCAVCEGPGELCDLFFCTSCGHHYHGACLDTALTARKRAGWQCPECKVCQACRKPGNDSKMLVCETCDKGYHTFCLKPPMEELPAHSWKCKACRVCRACGAGSAELNPNSEWFENYSLCHRCHKAQGGQTIRSVAEQHTPVCSRFSPPEPGDTPTDEPDALYVACQGQPKGGHVTSMQPKEPGPLQCEAKPLGKAGVQLEPQLEAPLNEEMPLLPPPEESPLSPPPEESPTSPPPEASRLSPPPEELPASPLPEALHLSRPLEESPLSPPPEESPLSPPPESSPFSPLEESPLSPPEESPPSPALETPLSPPPEASPLSPPFEESPLSPPPEELPTSPPPEASRLSPPPEESPMSPPPEESPMSPPPEASRLFPPFEESPLSPPPEESPLSPPPEASRLSPPPEDSPMSPPPEESPMSPPPEVSRLSPLPVVSRLSPPPEESPLSPPPEESPTSPPPEASRLSPPPEDSPTSPPPEDSPASPPPEDSLMSLPLEESPLLPLPEEPQLCPRSEGPHLSPRPEEPHLSPRPEEPHLSPQAEEPHLSPQPEEPCLCAVPEEPHLSPQAEGPHLSPQPEELHLSPQTEEPHLSPVPEEPCLSPQPEESHLSPQAGGTGMAPQTGGGY

SEQ ID NO: 819846 - protein, 637 aa, Homo sapiens
MPLLPPPEESPLSPPPEESPTSPPPEASRLSPPPEELPASPLPEALHLSRPLEESPLSPPPEESPLSPPPESSPFSPLEESPLSPPEESPPSPALETPLSPPPEASPLSPPFEESPLSPPPEELPTSPPPEASRLSPPPEESPMSPPPEESPMSPPPEASRLFPPFEESPLSPPPEESPLSPPPEASRLSPPPEDSPMSPPPEESPMSPPPEVSRLSPLPVVSRLSPPPEESPLSPPPEESPTSPPPEASRLSPPPEDSPTSPPPEDSPASPPPEDSLMSLPLEESPLLPLPEEPQLCPRSEGPHLSPRPEEPHLSPRPEEPHLSPQAEEPHLSPQPEEPCLCAVPEEPHLSPQAEGPHLSPQPEELHLSPQTEEPHLSPVPEEPCLSPQPEESHLSPQSEEPCLSPRPEESHLSPELEKPPLSPRPEKPPEEPGQCPAPEELPLFPPPGEPSLSPLLGEPALSEPGEPPLSPLPEELPLSPSGEPSLSPQLMPPDPLPPPLSPIITAAAPPALSPLGELEYPFGAKGDSDPESPLAAPILETPISPPPEANCTDPEPVPPMILPPSPGSPVGPASPILMEPLPPQCSPLLQHSLVPQNSPPSQCSPPALPLSVPSPLSPIGKVVGVSDEAELHEME

SEQ ID NO: 819847 - protein, 563 aa, Homo sapiens
ELGTGQYGCAPPEESPPSPALETPLSPPPEASPLSPPFEESPLSPPPEELPTSPPPEASRLSPPPEESPMSPPPEESPMSPPPEASRLFPPFEESPLSPPPEESPLSPPPEASRLSPPPEDSPMSPPPEESPMSPPPEVSRLSPLPVVSRLSPPPEESPLSPPPEESPTSPPPEASRLSPPPEDSPTSPPPEDSPASPPPEDSLMSLPLEESPLLPLPEEPQLCPRSEGPHLSPRPEEPHLSPRPEEPHLSPQAEEPHLSPQPEEPCLCAVPEEPHLSPQAEGPHLSPQPEELHLSPQTEEPHLSPVPEEPCLSPQPEESHLSPQSEEPCLSPRPEESHLSPELEKPPLSPRPEKPPEEPGQCPAPEELPLFPPPGEPSLSPLLGEPALSEPGEPPLSPLPEELPLSPSGEPSLSPQLMPPDPLPPPLSPIITAAAPPALSPLGELEYPFGAKGDSDPESPLAAPILETPISPPPEANCTDPEPVPPMILPPSPGSPVGPASPILMEPLPPQCSPLLQHSLVPQNSPPSQCSPPALPLSVPSPLSPIGKVVGVSDEAELHEME

SEQ ID NO: 819848 - protein, 441 aa, Homo sapiens
ALCNCGEPSLHGQRELRRFELPFDWPRCPVVSPGGSPGPNEAVLPSEDLSQIGFPEGLTPAHLGEPGGSCWAHHWCAAWSAGVWGQEGPELCGVDKAIFSGISQRCSHCTRLGASIPCRSPGCPRLYHFPCATASGSFLSMKTLQLLCPEHSEGAAYLEEARCAVCEGPGELCDLFFCTSCGHHYHGACLDTALTARKRAGWQCPECKVCQACRKPGNDSKMLVCETCDKGYHTFCLKPPMEELPAHSWKCKACRVCRACGAGSAELNPNSEWFENYSLCHRCHKAQGGQTIRSVAEQHTPVCSRFSPPEPGDTPTDEPDALYVACQGQPKGGHVTSMQPKEPGPLQCEAKPLGKAGVQLEPQLEAPLNEEMPLLPPPEESPLSPPPEESPTSPPPWHATYRASGSSVGVSPGSGGENLLHTGICCSATEQDSLTSLGFVT

SEQ ID NO: 819849 - protein, 404 aa, Homo sapiens
ALCNCGEPSLHGQRELRRFELPFDWPRCPVVSPGGSPGPNEAVLPSEDLSQIGFPEGLTPAHLGEPGGSCWAHHWCAAWSAGVWGQEGPELCGVDKAIFSGISQRCSHCTRLGASIPCRSPGCPRLYHFPCATASGSFLSMKTLQLLCPEHSEGAAYLEEARCAVCEGPGELCDLFFCTSCGHHYHGACLDTALTARKRAGWQCPECKVCQACRKPGNDSKMLVCETCDKGYHTFCLKPPMEELPAHSWKCKACRVCRACGAGSAELNPNSEWFENYSLCHRCHKAQGGQTIRSVAEQHTPVCSRFSPPEPGDTPTDEPDALYVACQGQPKGGHVTSMQPKEPGPLQCEAKPLGKAGVQLEPQLEAPLNEEMPLLPPPEESPLSPPPNISSTTTNHHPGTCMHH

SEQ ID NO: 819850 - protein, 400 aa, Homo sapiens
ALCNCGEPSLHGQRELRRFELPFDWPRCPVVSPGGSPGPNEAVLPSEDLSQIGFPEGLTPAHLGEPGGSCWAHHWCAAWSAGVWGQEGPELCGVDKAIFSGISQRCSHCTRLGASIPCRSPGCPRLYHFPCATASGSFLSMKTLQLLCPEHSEGAAYLEEARCAVCEGPGELCDLFFCTSCGHHYHGACLDTALTARKRAGWQCPECKVCQACRKPGNDSKMLVCETCDKGYHTFCLKPPMEELPAHSWKCKACRVCRACGAGSAELNPNSEWFENYSLCHRCHKAQGGQTIRSVAEQHTPVCSRFSPPEPGDTPTDEPDALYVACQGQPKGGHVTSMQPKEPGPLQCEAKPLGKAGVQLEPQLEAPLNEENHLNLEAEVAVSRGCATALQPGQQRETLS

SEQ ID NO: 819851 - protein, 339 aa, Homo sapiens
ALCNCGEPSLHGQRELRRFELPFDWPRCPVVSPGGSPGPNEAVLPSEDLSQIGFPEGLTPAHLGEPGGSCWAHHWCAAWSAGVWGQEGPELCGVDKAIFSGISQRCSHCTRLGASIPCRSPGCPRLYHFPCATASGSFLSMKTLQLLCPEHSEGAAYLEEARCAVCEGPGELCDLFFCTSCGHHYHGACLDTALTARKRAGWQCPECKVCQACRKPGNDSKMLVCETCDKGYHTFCLKPPMEELPAHSWKCKACRVCRACGAGSAELNPNSEWFENYSLCHRCHKAQGGQTIRSVAEQHTPVCSRFSPPEPGDTPTDEPDALYVACQGQPKVLRPGPCN

SEQ ID NO: 819852 - protein, 318 aa, Homo sapiens
ALCNCGEPSLHGQRELRRFELPFDWPRCPVVSPGGSPGPNEAVLPSEDLSQIGFPEGLTPAHLGEPGGSCWAHHWCAAWSAGVWGQEGPELCGVDKAIFSGISQRCSHCTRLGASIPCRSPGCPRLYHFPCATASGSFLSMKTLQLLCPEHSEGAAYLEEARCAVCEGPGELCDLFFCTSCGHHYHGACLDTALTARKRAGWQCPECKVCQACRKPGNDSKMLVCETCDKGYHTFCLKPPMEELPAHSWKCKACRVCRACGAGSAELNPNSEWFENYSLCHRCHKAQGGQTIRSVAEQHTPVCSRVFTPRASGSSRTP

SEQ ID NO: 819853 - protein, 68 aa, Homo sapiens
NSIPSEVAKDIMTILKRRYTNGQPTYEEMLNITNDQGNANPNHHEILPYSCKNAIIQKSKNRCWHECG

SEQ ID NO: 819854 - protein, 527 aa, Homo sapiens
MSEDSSALPWSINRDDYELQEVIGSGATAVVQAAYCAPKKEKVAIKRINLEKCQTSMDELLKEIQAMSQCHHPNIVSYYTSFVVKDELWLVMKLLSGGSVLDIIKHIVAKGEHKSGVLDESTIATILREVLEGLEYLHKNGQIHRDVKAGNILLGEDGSVQIADFGVSAFLATGGDITRNKVRKTFVGTPCWMAPEVMEQVRGYDFKADIWSFGITAIELATGAAPYHKYPPMKVLMLTLQNDPPSLETGVQDKEMLKKYGKSFRKMISLCLQKDPEKRPTAAELLRHKFFQKAKNKEFLQEKTLQRAPTISERAKKVRRVPGSSGRLHKTEDGGWEWSDDEFDEESEEGKAAISQLRSPRVKESISNSELFPTTDPVGTLLQVPEQISAHLPQPAGQIATQPTQVSLPPTAEPAKTAQALSSGSGSQETKIPISLVLRLRNSKKELNDIRFEFTPGRDTAEGVSQELISAGLVDGRDLVIVAANLQKIVEEPQSNRSVTFKLASGVEGSDIPDDGKLIGFAQLSIS

SEQ ID NO: 819855 - protein, 527 aa, Homo sapiens; identical to SEQ ID NO: 819854

SEQ ID NO: 819856 - protein, 527 aa, Homo sapiens; identical to SEQ ID NO: 819854

SEQ ID NO: 819857 - protein, 252 aa, Homo sapiens
MLTLQNDPPSLETGVQDKEMNKEFLQEKTLQRAPTISERAKKVRRVPGSSGRLHKTEDGGWEWSDDEFDEESEEGKAAISQLRSPRVKESISNSELFPTTDPVGTLLQVPEQISAHLPQPAGQIATQPTQVSLPPTAEPAKTAQALSSGSGSQETKIPISLVLRLRNSKKELNDIRFEFTPGRDTAEGVSQELISAGLVDGRDLVIVAANLQKIVEEPQSNRSVTFKLASGVEGSDIPDDGKLIGFAQLSIS

SEQ ID NO: 819858 - protein, 222 aa, Homo sapiens
FLVPGPQMSGPNMKVHVIFNYKGKNVLINKDIRCKDDEFTHLYTLIVRPDNTYEVKMKESISNSELFPTTDPVGTLLQVPEQISAHLPQPAGQIATQPTQVSLPPTAEPAKTAQALSSGSGSQETKIPISLVLRLRNSKKELNDIRFEFTPGRDTAEGVSQELISAGLVDGRDLVIVAANLQKIVEEPQSNRSVTFKLASGVEGSDIPDDGKLIGFAQLSIS

SEQ ID NO: 819859 - protein, 527 aa, Homo sapiens; identical to SEQ ID NO: 819854

SEQ ID NO: 819860 - protein, 527 aa, Homo sapiens; identical to SEQ ID NO: 819854

SEQ ID NO: 819861 - protein, 97 aa, Homo sapiens
MIPSGGLWPDLGLVLEESLQQQQQEQEEALKQCREQHAAELKGKEEELQDVRDQLEQAQEERDCHLKTISSLKQEVKDTGPGQRTNVDPAANLVVVV

SEQ ID NO: 819862 - protein, 834 aa, Homo sapiens
EEFQRMQAQLLELRTNNYQLSDELRKNGVELTSLRQKVAYLDKEFSKAQKALSKSKKAQEVEVLLSENEMLQAKLHSQEEDFRLQNSTLMAEFSKLCSQMEQLEQENQQLKEGAAGAGVAQAGPLVDGELLRLQAENTALQKNVAALQERYGKEAGKFSAVSEGQGDPPGGPAPTVLAPMPLAEVELKWEMEKEEKRLLWEQLQGLESSKQAETSRLQEELAKLSEKLKKKQESFCRLQTEKETLFNDSRNKIEELQQRKEADHKAQLARTQKLQQELEAANQSLAELRDQRQGERLEHAAALRALQDQVSIQSADAQEQVEGLLAENNALRTSLAALEQIQTAKTQELNMLREQTTGLAAELQQQQAEYEDLMGQKDDLNSQLQESLRANSRLLEQLQEIGQEKEQLTQELQEARKSAEKRKAMLDELAMETLQEKSQHKEELGAVRLRHEKEVLGVRARYERELRELHEDKKRQEEELRGQIREEKARTRELETLQQTVEELQAQVHSMDGAKGWFERRLKEAEESLQQQQQEQEEALKQCREQHAAELKGKEEELQDVRDQLEQAQEERDCHLKTISSLKQEVKDTVDGQRILEKKGSAALKDLKRQLHLERKRADKLQERLQDILTNSKSRSGLEELVLSEMNSPSRTQTGDSSSISSFSYREILREKESSAVPARSLSSSPQAQPPRPAELSDEEVAELFQRLAETQQEKWMLEEKVKHLEVSSASMAEDLCRKSAIIETYVMDSRIDVSVAAGHTDRSGLGSVLRDLVKPGDENLREMNKKLQNMLEEQLTKNMHLHKDMEVLSQEIVRLSKECVGPPDPDLEPGETS

SEQ ID NO: 819863 - protein, 593 aa, Homo sapiens
LDTLRATGAENMLLGGQTESLYGLYAPQERLRCKMGSPGLLQSLAELRDQRQGERLEHAAALRALQDQVSIQSADAQEQVEGLLAENNALRTSLAALEQIQTAKTQELNMLREQTTGLAAELQQQQAEYEDLMGQKDDLNSQLQESLRANSRLLEQLQEIGQEKEQLTQELQEARKSAEKRKAMLDELAMETLQEKSQHKEELGAVRLRHEKEVLGVRARYERELRELHEDKKRQEEELRGQIREEKARTRELETLQQTVEELQAQVHSMDGAKGWFERRLKEAEESLQQQQQEQEEALKQCREQHAAELKGKEEELQDVRDQLEQAQEERDCHLKTISSLKQEVKDTVDGQRILEKKGSAALKDLKRQLHLERKRADKLQERLQDILTNSKSRSGLEELVLSEMNSPSRTQTGDSSSISSFSYREILREKESSAVPARSLSSSPQAQPPRPAELSDEEVAELFQRLAETQQEKWMLEEKVKHLEVSSASMAEDLCRKSAIIETYVMDSRIDVSVAAGHTDRSGLGSVLRDLVKPGDENLREMNKKLQNMLEEQLTKNMHLHKDMEVLSQEIVRLSKECVGPPDPDLEPGETS

SEQ ID NO: 819864 - protein, 748 aa, Homo sapiens
EEFQRMQAQLLELRTNNYQLSDELRKNGVELTSLRQKVAYLDKEFSKAQKALSKSKKAQEVEVLLSENEMLQAKLHSQEEDFRLQNSTLMAEFSKLCSQMEQLEQENQQLKEGAAGAGVAQAGPLVDGELLRLQAENTALQKNVAALQERYGKEAGKFSAVSEGQGDPPGGPAPTVLAPMPLAEVELKWEMEKEEKRLLWEQLQGLESSKQAETSRLQEELAKLSEKLKKKQESFCRLQTEKETLFNDSRNKIEELQQRKEADHKAQLARTQKLQQELEAANQSLAELRDQRQGERLEHAAALRALQDQVSIQSADAQEQVEGLLAENNALRTSLAALEQIQTAKTQELNMLREQTTGLAAELQQQQAEYEDLMGQKDDLNSQLQESLRANSRLLEQLQEIGQEKEQLTQELQEARKSAEKRKAMLDELAMETLQEKSQHKEELGAVRLRHEKEVLGVRARYERELRELHEDKKRQEEELRGQIREEKARTRELETLQQTVEELQAQVHSMDGAKGWFERRLKEAEESLQQQQQEQEEALKQCREQHAAELKGKEEELQDVRDQLEQAQEERDCHLKTISSLKQEVKDTVDGQRILEKKGSAALKDLKRQLHLERKRADKLQERLQDILTNSKSRSGLEELVLSEMNSPSRTQTGDSSSISSFSYREILREKESSAVPARSLSSSPQAQPPRPAELSDEEVAELFQRLAETQQEKWMLEEKVLPACLPAHPHLKCPCGCGVCPGPPHV

SEQ ID NO: 819865 - protein, 1070 aa, Homo sapiens
EEFQRMQAQLLELRTNNYQLSDELRKNGVELTSLRQKVAYLDKEFSKAQKALSKSKKAQEVEVLLSENEMLQAKLHSQEEDFRLQNSTLMAEFSKLCSQMEQLEQENQQLKEGAAGAGVAQAGPLVDGELLRLQAENTALQKNVAALQERYGKEAGKFSAVSEGQGDPPGGPAPTVLAPMPLAEVELKWEMEKEEKRLLWEQLQGLESSKQAETSRLQEELAKLSEKLKKKQESFCRLQTEKETLFNDSRNKIEELQQRKEADHKAQLARTQKLQQELEAANQSLAELRDQRQGERLEHAAALRALQDQVSIQSADAQEQVEGLLAENNALRTSLAALEQIQTAKTQELNMLREQTTGLAAELQQQQAEYEDLMGQKDDLNSQLQESLRANSRLLEQLQEIGQEKEQLTQELQEARKSAEKRKAMLDELAMETLQEKSQHKEELGAVRLRHEKEVLGVRARYERELRELHEDKKRQEEELRGQIREEKARTRELETLQQTVEELQAQVHSMDGAKGWFERRLKEAEESLQQQQQEQEEALKQCREQHAAELKGKEEELQDVRDQLEQAQEERDCHLKTISSLKQEVKDTVDGQRILEKKGSAALKDLKRQLHLERKRADKLQERLQDILTNSKSRSGLEELVLSEMNSPSRTQTGDSSSISSFSYREILREKESSAVPARSLSSSPQAQPPRPAELSDEEVAELFQRLAETQQEKWMLEEKVKHLEVSSASMAEDLCRKSAIIETYVMDSRIGQCPLPGPQPGPAFTWPSLSILCCGFSPLLSELSEATDKTMACGGENRKALSLDLASSLFSLSLSSLHSPFSIVSLCPLSPFLSLCLIFLSSLSPFSLLRFSFSPHSFILSRCLYCFPSLYLHCFCFLSNFLLHRFFFINQNHTDQHVLRTFCVLCASHTVMCIFPVPQVSYSSFLGAIELVSDRARFCMSKPLSYMTWLFLLPSPLVFVSLFSPLALPGSPLALPRGWFSAWALADVSVAAGHTDRSGLGSVLRDLVKPGDENLREMNKKLQNMLEEQLTKNMHLHKDMEVLSQEIVRLSKECVGPPDPDLEPGETS

SEQ ID NO: 819866 - protein, 129 aa, Homo sapiens [sequence omitted]

SEQ ID NO: 819867 - protein, 815 aa, Homo sapiens
EEFQRMQAQLLELRTNNYQLSDELRKNGVELTSLRQKVAYLDKEFSKAQKALSKSKKAQEVEVLLSENEMLQAKLHSQEEDFRLQNSTLMAEFSKLCSQMEQLEQENQQLKEGAAGAGVAQAGPLVDGELLRLQAENTALQKNVAALQERYGKEAGKFSAVSEGQGDPPGGPAPTVLAPMPLAEVELKWEMEKEEKRLLWEQLQGLESSKQAETSRLQEELAKLSEKLKKKQESFCRLQTEKETLFNDSRNKIEELQQRKEADHKAQLARTQKLQQELEAANQSLAELRDQRQGERLEHAAALRALQDQVSIQSADAQEQVEGLLAENNALRTSLAALEQIQTAKTQELNMLREQTTGLAAELQQQQAEYEDLMGQKDDLNSQLQESLRANSRLLEQLQEIGQEKEQLTQELQEARKSAEKRKAMLDELAMETLQEKSQHKEELGAVRLRHEKEVLGVRARYERELRELHEDKKRQEEELRGQIREEKARTRELETLQQTVEELQAQVHSMDGAKGWFERRLKEAEESLQQQQQEQEEALKQCREQHAAELKGKEEELQDVRDQLEQAQEERDCHLKTISSLKQEVKDTVDGQRILEKKGSAALKDLKRQLHLERKRADKLQERLQDILTNSKSRSGLEELVLSEMNSPSRTQTGDSSSISSFSYREILREKESSAVPARSLSSSPQAQPPRPAELSDEEVAELFQRLAETQQEKWMLEEKVKHLEVSSASMAEDLCRKSAIIETYVMDSRIDVSVAAGHTDRSGLGSVLRDLVKPETNSFLFYFILFFNLCLEPGYSAFGIGDAGWVCGPCSAF

SEQ ID NO: 819868 - protein, 706 aa, Homo sapiens
EEFQRMQAQLLELRTNNYQLSDELRKNGVELTSLRQKVAYLDKEFSKAQKALSKSKKAQEVEVLLSENEMLQAKLHSQEEDFRLQNSTLMAEFSKLCSQMEQLEQENQQLKEGAAGAGVAQAGPLVDGELLRLQAENTALQKNVAALQERYGKEAGKFSAVSEGQGDPPGGPAPTVLAPMPLAEVELKWEMEKEEKRLLWEQLQGLESSKQAETSRLQEELAKLSEKLKKKQESFCRLQTEKETLFNDSRNKIEELQQRKEADHKAQLARTQKLQQELEAANQSLAELRDQRQGERLEHAAALRALQDQVSIQSADAQEQVEGLLAENNALRTSLAALEQIQTAKTQELNMLREQTTGLAAELQQQQAEYEDLMGQKDDLNSQLQESLRANSRLLEQLQEIGQEKEQLTQELQEARKSAEKRKAMLDELAMETLQEKSQHKEELGAVRLRHEKEVLGVRARYERELRELHEDKKRQEEELRGQIREEKTPFYTNTYSDATVTLKSISYPTRLRTNLPYCNLLLRKKRTIWIHRYGLELMISIGFPRRHPCEHTIYAQTGTETVDNTSIFQLRYHNPLYSQPGVKQLADVRKSTGNARTAKRPAALTTKTKDTDNITTDRGPEGEEAIPKHNRDNEPHQNDKTRNAHTQKSRHKSAAIPTSQRTTPRRHQHQRSTTKTHTHTHSITDSARPTTHHTAQKARDKLTAR

SEQ ID NO: 819869 - protein, 387 aa, Homo sapiens
MACTIQKAEALDGAHLMQILWYDEEESLYPAVWLRDNCPCSDCYLDSAKARKLLVEALDVNIGIKGLIFDRKKVYITWPDEHYSEFQADWLKKRCFSKQARAKLQRELFFPECQYWGSELQLPTLDFEDVLRYDEHAYKWLSTLKKVGIVRLTGASDKPGEVSKLGKRMGFLYLTFYGHTWQVQDKIDANNVAYTTGKLSFHTDYPALHHPPGVQLLHCIKQTVTGGDSEIVDGFNVCQKLKKNNPQAFQILSSTFVDFTDIGVDYCDFSVQSKHKIIELDDKGQVVRINFNNATRDTIFDVPVERVQPFYAALKEFVDLMNSKESKFTFKMNPGDVITFDNWRLLHGRRSYEAGTEISRHLEGAYADWDVVMSRLRILRQRVENGN

SEQ ID NO: 819870 - protein, 387 aa, Homo sapiens; identical to SEQ ID NO: 819869

SEQ ID NO: 819871 - protein, 227 aa, Homo sapiens
MLFQAGQSKAPKRIVFSRHTWQVQDKIDANNVAYTTGKLSFHTDYPALHHPPGVQLLHCIKQTVTGGDSEIVDGFNVCQKLKKNNPQAFQILSSTFVDFTDIGVDYCDFSVQSKHKIIELDDKGQVVRINFNNATRDTIFDVPVERVQPFYAALKEFVDLMNSKESKFTFKMNPGDVITFDNWRLLHGRRSYEAGTEISRHLEGAYADWDVVMSRLRILRQRVENGN

SEQ ID NO: 819872 - protein, 219 aa, Homo sapiens
MGFLYLTFYGHTWQVQDKIDANNVAYTTGKLSFHTDYPALHHPPGVQLLHCIKQTVTGGDSEIVDGFNVCQKLKKNNPQAFQILSSTFVDFTDIGVDYCDFSVQSKHKIIELDDKGQVVRINFNNATRDTIFDVPVERVQPFYAALKEFVDLMNSKESKFTFKMNPGDVITFDNWRLLHGRRSYEAGTEISRHLEGAYADWDVVMSRLRILRQRVENGN

SEQ ID NO: 819873 - protein, 279 aa, Homo sapiens
MACTIQKAEALDGAHLMQILWYDEEESLYPAVWLRDNCPCSDCYLDSAKARKLLVEALDVNIGIKGLIFDRKKVYITWPDEHYSEFQADWLKKRCFSKQARAKLQRELFFPECQYWGSELQLPTLDFEDVLRYDEHAYKWLSTLKKVGIVRLTGASDKPGEVSKLGKRMGFLYLTFYGHTWQVQDKIDANNVAYTTGKLSFHTDYPALHHPPGVQLLHCIKQTVTGGDSEIVDGFNVCQKLKKNNPQAFQILSSTFVDFTDIGVDYCDFSVQSKHKIIE

SEQ ID NO: 819874 - protein, 150 aa, Homo sapiens
MACTIQKAEALDGAHLMQILWYDEEESLYPAVWLRDNCPCSDCYLDSAKARKLLVEALDVNIGIKGLIFDRKKVYITWPDEHYSEFQADWLKKRCFSKQARAKLQRELFFPGNFAKVFNVFLNPYSKGFLLRNLLTENSNLCALIKICDM

SEQ ID NO: 819875 - protein, 72 aa, Homo sapiens
GRVGRPTLSLAMDPNCSCAAGDSCTCAGSCKCKECKCTSCKKSCCSCCPVGCAKCAQGCICKGASDKCSCCA

SEQ ID NO: 819876 - protein, 81 aa, Homo sapiens
GRLLLLLLLLEFKLLTMYGDMDPNCSCAAGDSCTCAGSCKCKECKCTSCKKSCCSCCPVGCAKCAQGCICKGASDKCSCCA

SEQ ID NO: 819877 - protein, 72 aa, Homo sapiens; identical to SEQ ID NO: 819875

SEQ ID NO: 819878 - protein, 118 aa, Homo sapiens
KSQRTRVQTVPDSSRLFSSPWIPTAPAPPVTPAPAPAPANAKSANAPPARKAAAPAALWAVPSVPRAASAKGRRTSAAAAPDAGTAPLPDVKNATSTNLDFLCTTLTVTVCYIPFSMK

SEQ ID NO: 819879 - protein, 105 aa, Homo sapiens
MHLLQEKVSGILSFLYPFPVLQPVPSPPSSGELKQSGDAPLRGNCCLLSDPYQGEQESLFPVSLVLISAASCLPPGCCSCCPVGCAKCAQGCICKGASDKCSCCA

SEQ ID NO: 819880 - protein, 116 aa, Homo sapiens
ASALSNMVAALREGGFLLLHTLLRGHPLGDIVAFLTSTEPQYGQGILSQDAWESLFSRVSLRLVGLKKSFYGSCKCKECKCTSCKKSCCSCCPVGCAKCAQGCICKGASDKCSCCA

SEQ ID NO: 819881 - protein, 118 aa, Homo sapiens; identical to SEQ ID NO: 819878

SEQ ID NO: 819882 - protein, 72 aa, Homo sapiens
KSQRTRVQTVPDSSRLFSSPWIPTAPAPPVTPAPAPAPANAKSANAPPARKQRGVGQVQLLRLMLGQPRSQM

SEQ ID NO: 819883 - protein, 91 aa, Homo sapiens
KSQRTRVQTVPDSSRLFSSPWIPTAPAPPVTPAPAPAPANAKTKGRRTSAAAAPDAGTAPLPDVKNATSTNLDFLCTTLTVTVCYIPFSMK

SEQ ID NO: 819884 - protein, 72 aa, Homo sapiens; identical to SEQ ID NO: 819875

SEQ ID NO: 819885 - protein, 81 aa, Homo sapiens; identical to SEQ ID NO: 819876

SEQ ID NO: 819886 - protein, 72 aa, Homo sapiens; identical to SEQ ID NO: 819875

SEQ ID NO: 819887 - protein, 72 aa, Homo sapiens; identical to SEQ ID NO: 819875

SEQ ID NO: 819888 - protein, 72 aa, Homo sapiens; identical to SEQ ID NO: 819875

SEQ ID NO: 819889 - protein, 105 aa, Homo sapiens; identical to SEQ ID NO: 819879

SEQ ID NO: 819890 - protein, 95 aa, Homo sapiens
SEEKGGVEVLESCQGSSNGAQDQEASEQFGSPVAERGKRLPGVAGQYLFKCLINVKKEVDDALVEMHWVEGQNRDLMNQLCTYIRNQIFRLVAVN

SEQ ID NO: 819891 - protein, 95 aa, Homo sapiens; identical to SEQ ID NO: 819890

SEQ ID NO: 819892 - protein, 95 aa, Homo sapiens; identical to SEQ ID NO: 819890

SEQ ID NO: 819893 - protein, 95 aa, Homo sapiens; identical to SEQ ID NO: 819890

SEQ ID NO: 819894 - protein, 95 aa, Homo sapiens; identical to SEQ ID NO: 819890

SEQ ID NO: 819895 - protein, 95 aa, Homo sapiens; identical to SEQ ID NO: 819890

SEQ ID NO: 819896 - protein, 95 aa, Homo sapiens; identical to SEQ ID NO: 819890

SEQ ID NO: 819897 - protein, 95 aa, Homo sapiens; identical to SEQ ID NO: 819890

SEQ ID NO: 819898 - protein, 69 aa, Homo sapiens
VFDRLSGLSNISLVALHSMMALPHAFWSTMVLLDYMMSVYLTSDCPGCSQVRYCERCWLEDLARGSDLL

SEQ ID NO: 819899 - protein, 95 aa, Homo sapiens; identical to SEQ ID NO: 819890

SEQ ID NO: 819900 - protein, 95 aa, Homo sapiens; identical to SEQ ID NO: 819890

SEQ ID NO: 819901 - protein, 2042 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 819902 - protein, 2053 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSPNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 819903 - protein, 1377 aa, Homo sapiens
MTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSPNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 819904 - protein, 1594 aa, Homo sapiens
MRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSPNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 819905 - protein, 920 aa, Homo sapiens
AAYASHSRFSAAPADDRAPFYVITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSPNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 819906 - protein, 1127 aa, Homo sapiens
VIFDLAGSPPFDQVPGKPNLPGHLLWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSPNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 819907 - protein, 774 aa, Homo sapiens
WRAQREGTAWEVWDSQQWMVSKTVILRVFRRLSKLSMRVTNNNFIIYSQYLISDFESSIRGCYPMLCEALYDELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSPNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 819908 - protein, 2042 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 819909 - protein, 1598 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQYKQIINTSNFCF

SEQ ID NO: 819910 - protein, 504 aa, Homo sapiens
MGPFLCPIPQSQSVDEFDGYALVTNFYLYFIFNLFLDTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 819911 - protein, 2022 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 819912 - protein, 2053 aa, Homo sapiens; identical to SEQ ID NO: 819902

SEQ ID NO: 819913 - protein, 1849 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSPNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLSSRDTW

SEQ ID NO: 819914 - protein, 1671 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLVPLLSMKFNSSGGTSTIPDK

SEQ ID NO: 819915 - protein, 1218 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVPSSELLC

SEQ ID NO: 819916 - protein, 1155 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPGSPERERRLYVRTQAHFSPGTVPGAVAPGRES

SEQ ID NO: 819917 - protein, 1686 aa, Homo sapiens
MAQISSNSGFKECPSSHPEPTRAKDVDKEEALQMEAEALAKLQKDRQVTDNQRGFELSSSTRKKAQVYNKQDYDLMVFPESDSQKRALDIDVEKLTQAELEKLLLDDSFETKKTPVLPVTPILSPSFSAQLYFRPTIQRGQWPPGLPGPSTYALPSIYPSTYSKQAAFQNGFNPRMPTFPSTEPIYLSLPGQSPYFSYPLTPATPFHPQGSLPIYRPVVSTDMAKLFDKIASTSEFLKNGKARTDLEITDSKVSNLQVSPKSEDISKFDWLDLDPLSKPKVDNVEVLDHEEEKNVSSLLAKDPWDAVLLEERSTANCHLERKVNGKSLSVATVTRSQSLNIRTTQLAKAQGHISQKDPNGTSSLPTGSSLLQEVEVQNEEMAAFCRSITKLKTKFPYTNHRTNPGYLLSPVTAQRNICGENASVKVSIDIEGFQLPVTFTCDVSSTVEIIIMQALCWVHDDLNQVDVGSYVLKVCGQEEVLQNNHCLGSHEHIQNCRKWDTEIRLQLLTFSAMCQNLARTAEDDETPVDLNKHLYQIEKPCKEAMTRHPVEELLDSYHNQVELALQIENQHRAVDQVIKAVRKICSALDGVETLAITESVKKLKRAVNLPRSKTADVTSLFGGEDTSRSSTRGSLNPENPVQVSINQLTAAIYDLLRLHANSGRSPTDCAQSSKSVKEAWTTTEQLQFTIFAAHGISSNWVSNYEKYYLICSLSHNGKDLFKPIQSKKVGTYKNFFYLIKWDELIIFPIQISQLPLESVLHLTLFGILNQSSGSSPDSNKQRKGPEALGKVSLPLCDFKRFLTCGTKLLYLWTSSHTNSVPGTVTKKGYVMERIVLQVDFPSPAFDIIYTTPQVDRSIIQQHNLETLENDIKGKLLDILHKDSSLGLSKEDKAFLWEKRYYCFKHPNCLPKILASAPNWKWVNLAKTYSLLHQWPALYPLIALELLDSKFADQEVRSLAVTWIEAISDDELTDLLPQFVQALKYEIYLNSSLVQFLLSRALGNIQIAHNLYWLLKDALHDVQFSTRYEHVLGALLSVGGKRLREELLKQTKLVQLLGGVAEKVRQASGSARQVVLQRSMERVQSFFQKNKCRLPLKPSLVAKELNIKSCSFFSSNAVPLKVTMVNADPMGEEINVMFKVGEDLRQDMLALQMIKIMDKIWLKEGLDLRMVIFKCLSTGRDRGMVELVPASDTLRKIQVEYGVTGSFKDKPLAEWLRKYNPSEEEYEKASENFIYSCAGCCVATYVLGICDRHNDNIMLRSTGHMFHIDFGKFLGHAQMFGSFKRDRAPFVLTSDMAYVINGGEKPTIRFQLFVDLCCQAYNLIRKQTNLFLNLLSLMIPSGLPELTSIQDLKYVRDALQPQTTDAEATIFFTRLIESSLGSIATKFNFFIHNLAQLRFSGLPSNDEPILSFSPKTYSFRQDGRIKEVSVFTYHKKYNPDKHYIYVVRILREGQIEPSFVFRTFDEFQELHNKLSIIFPLWKLPGFPNRMVLGRTHIKDVAAKRKIELNSYLQSLMNASTDVAECDLVCTFFHPLLRDEKAEGIARSADAGSFSPTPGQIGGAVKLSISYRNGTLFIMVMHIKDLVTEDGADPNPYVKTYLLPDNHKTSKRKTKISRKTRNPTFNEMLVYSGYSKETLRQRELQLSVLSAESLRENFFLGGVTLPLKDFNLSKETVKWYQLTAATYL

SEQ ID NO: 819918 - protein, 1686 aa, Homo sapiens; identical to SEQ ID NO: 819917

SEQ ID NO: 819919 - protein, 1686 aa, Homo sapiens; identical to SEQ ID NO: 819917

SEQ ID NO: 819920 - protein, 1668 aa, Homo sapiens
MAQISSNSGFKECPSSHPEPTRAKDVDKEEALQMEAEALAKLQKDRQVTDNQRGFELSSSTRKKAQVYNKQDYDLMVFPESDSQKRALDIDVEKLTQAELEKLLLDDSFETKKTPVLPVTPILSPSFSAQLYFRPTIQRGQWPPGLPGPSTYALPSIYPSTYSKQAAFQNGFNPRMPTFPSTEPIYLSLPGQSPYFSYPLTPATPFHPQGSLPIYRPVVSTDMAKLFDKIASTSEFLKNGKARTDLEITDSKVSNLQVSPKSEDISKFDWLDLDPLSKPKVDNVEVLDHEEEKNVSSLLAKDPWDAVLLEERSTANCHLERKVNGKSLSVATVTRSQSLNIRTTQLAKAQGHISQKDPNGTSSLPTGSSLLQEVEVQNEEMAAFCRSITKLKTKFPYTNHRTNPGYLLSPVTAQRNICGENASVKVSIDIEGFQLPVTFTCDVSSTVEIIIMQALCWVHDDLNQVDVGSYVLKVCGQEEVLQNNHCLGSHEHIQNCRKWDTEIRLQLLTFSAMCQNLARTAEDDETPVDLNKHLYQIEKPCKEAMTRHPVEELLDSYHNQVELALQIENQHRAVDQVIKAVRKICSALDGVETLAITESVKKLKRAVNLPRSKTADVTSLFGGEDTSRSSTRGSLNPENPVQVSINQLTAAIYDLLRLHANSGRSPTDCAQSSKSVKEAWTTTEQLQFTIFAAHGISSNWVSNYEKYYLICSLSHNGKDLFKPIQSKKVGTYKNFFYLIKWDELIIFPIQISQLPLESVLHLTLFGILNQSSGSSPDSNKQRKGPEALGKVSLPLCDFKRFLTCGTKLLYLWTSSHTNSVPGTVTKKGYVMERIVLQVDFPSPAFDIIYTTPQVDRSIIQQHNLETLENDIKGKLLDILHKDSSLGLSKEDKAFLWEKRYYCFKHPNCLPKILASAPNWKWVNLAKTYSLLHQWPALYPLIALELLDSKFADQEVRSLAVTWIEAISDDELTDLLPQFVQALKYEIYLNSSLVQFLLSRALGNIQIAHNLYWLLKDALHDVQFSTRYEHVLGALLSVGGKRLREELLKQTKLVQLLGGVAEKVRQASGSARQVVLQRSMERVQSFFQKNKCRLPLKPSLVAKELNIKSCSFFSSNAVPLKVTMVNADPMGEEINVMFKVGEDLRQDMLALQMIKIMDKIWLKEGLDLRMVIFKCLSTGRDRGMVELVPASDTLRKIQVEYGVTGSFKDKPLAEWLRKYNPSEEEYEKASENFIYSCAGCCVATYVLGICDRHNDNIMLRSTGHMFHIDFGKFLGHAQMFGSFKRDRAPFVLTSDMAYVINGGEKPTIRFQLFVDLCCQAYNLIRKQTNLFLNLLSLMIPSGLPELTSIQDLKYVRDALQPQTTDAEATIFFTRLIESSLGSIATKFNFFIHNLAQLRFSGLPSNDEPILSFSPKTYSFRQDGRIKEVSVFTYHKKYNPDKHYIYVVRILREGQIEPSFVFRTFDEFQELHNKLSIIFPLWKLPGFPNRMVLGRTHIKDVAAKRKIELNSYLQSLMNASTDVAECDLVCTFFHPLLRDEKAEGIARSADAGSFSPTPGQIGGAVKLSISYRNGTLFIMVMHIKDLVTEDGADPNPYVKTYLLPDNHKTSKRKTKISRKTLRQRELQLSVLSAESLRENFFLGGVTLPLKDFNLSKETVKWYQLTAATYL

SEQ ID NO: 819921 - protein, 1174 aa, Homo sapiens
MCQNLARTAEDDETPVDLNKHLYQIEKPCKEAMTRHPVEELLDSYHNQVELALQIENQHRAVDQVIKAVRKICSALDGVETLAITESVKKLKRAVNLPRSKTADVTSLFGGEDTSRSSTRGSLNPENPVQVSINQLTAAIYDLLRLHANSGRSPTDCAQSSKSVKEAWTTTEQLQFTIFAAHGISSNWVSNYEKYYLICSLSHNGKDLFKPIQSKKVGTYKNFFYLIKWDELIIFPIQISQLPLESVLHLTLFGILNQSSGSSPDSNKQRKGPEALGKVSLPLCDFKRFLTCGTKLLYLWTSSHTNSVPGTVTKKGYVMERIVLQVDFPSPAFDIIYTTPQVDRSIIQQHNLETLENDIKGKLLDILHKDSSLGLSKEDKAFLWEKRYYCFKHPNCLPKILASAPNWKWVNLAKTYSLLHQWPALYPLIALELLDSKFADQEVRSLAVTWIEAISDDELTDLLPQFVQALKYEIYLNSSLVQFLLSRALGNIQIAHNLYWLLKDALHDVQFSTRYEHVLGALLSVGGKRLREELLKQTKLVQLLGGVAEKVRQASGSARQVVLQRSMERVQSFFQKNKCRLPLKPSLVAKELNIKSCSFFSSNAVPLKVTMVNADPMGEEINVMFKVGEDLRQDMLALQMIKIMDKIWLKEGLDLRMVIFKCLSTGRDRGMVELVPASDTLRKIQVEYGVTGSFKDKPLAEWLRKYNPSEEEYEKASENFIYSCAGCCVATYVLGICDRHNDNIMLRSTGHMFHIDFGKFLGHAQMFGSFKRDRAPFVLTSDMAYVINGGEKPTIRFQLFVDLCCQAYNLIRKQTNLFLNLLSLMIPSGLPELTSIQDLKYVRDALQPQTTDAEATIFFTRLIESSLGSIATKFNFFIHNLAQLRFSGLPSNDEPILSFSPKTYSFRQDGRIKEVSVFTYHKKYNPDKHYIYVVRILREGQIEPSFVFRTFDEFQELHNKLSIIFPLWKLPGFPNRMVLGRTHIKDVAAKRKIELNSYLQSLMNASTDVAECDLVCTFFHPLLRDEKAEGIARSADAGSFSPTPGQIGGAVKLSISYRNGTLFIMVMHIKDLVTEDGADPNPYVKTYLLPDNHKTSKRKTKISRKTRNPTFNEMLVYSGYSKETLRQRELQLSVLSAESLRENFFLGGVTLPLKDFNLSKETVKWYQLTAATYL

SEQ ID NO: 819922 - protein, 587 aa, Homo sapiens
MLNMWYLQSCSFFSSNAVPLKVTMVNADPMGEEINVMFKVGEDLRQDMLALQMIKIMDKIWLKEGLDLRMVIFKCLSTGRDRGMVELVPASDTLRKIQVEYGVTGSFKDKPLAEWLRKYNPSEEEYEKASENFIYSCAGCCVATYVLGICDRHNDNIMLRSTGHMFHIDFGKFLGHAQMFGSFKRDRAPFVLTSDMAYVINGGEKPTIRFQLFVDLCCQAYNLIRKQTNLFLNLLSLMIPSGLPELTSIQDLKYVRDALQPQTTDAEATIFFTRLIESSLGSIATKFNFFIHNLAQLRFSGLPSNDEPILSFSPKTYSFRQDGRIKEVSVFTYHKKYNPDKHYIYVVRILREGQIEPSFVFRTFDEFQELHNKLSIIFPLWKLPGFPNRMVLGRTHIKDVAAKRKIELNSYLQSLMNASTDVAECDLVCTFFHPLLRDEKAEGIARSADAGSFSPTPGQIGGAVKLSISYRNGTLFIMVMHIKDLVTEDGADPNPYVKTYLLPDNHKTSKRKTKISRKTRNPTFNEMLVYSGYSKETLRQRELQLSVLSAESLRENFFLGGVTLPLKDFNLSKETVKWYQLTAATYL

SEQ ID NO: 819923 - protein, 1393 aa, Homo sapiens
MAQISSNSGFKECPSSHPEPTRAKDVDKEEALQMEAEALAKLQKDRQVTDNQRGFELSSSTRKKAQVYNKQDYDLMVFPESDSQKRALDIDVEKLTQAELEKLLLDDSFETKKTPVLPVTPILSPSFSAQLYFRPTIQRGQWPPGLPGPSTYALPSIYPSTYSKQAAFQNGFNPRMPTFPSTEPIYLSLPGQSPYFSYPLTPATPFHPQGSLPIYRPVVSTDMAKLFDKIASTSEFLKNGKARTDLEITDSKVSNLQVSPKSEDISKFDWLDLDPLSKPKVDNVEVLDHEEEKNVSSLLAKDPWDAVLLEERSTANCHLERKVNGKSLSVATVTRSQSLNIRTTQLAKAQGHISQKDPNGTSSLPTGSSLLQEVEVQNEEMAAFCRSITKLKTKFPYTNHRTNPGYLLSPVTAQRNICGENASVKVSIDIEGFQLPVTFTCDVSSTVEIIIMQALCWVHDDLNQVDVGSYVLKVCGQEEVLQNNHCLGSHEHIQNCRKWDTEIRLQLLTFSAMCQNLARTAEDDETPVDLNKHLYQIEKPCKEAMTRHPVEELLDSYHNQVELALQIENQHRAVDQVIKAVRKICSALDGVETLAITESVKKLKRAVNLPRSKTADVTSLFGGEDTSRSSTRGSLNPENPVQVSINQLTAAIYDLLRLHANSGRSPTDCAQSSKSVKEAWTTTEQLQFTIFAAHGISSNWVSNYEKYYLICSLSHNGKDLFKPIQSKKVGTYKNFFYLIKWDELIIFPIQISQLPLESVLHLTLFGILNQSSGSSPDSNKQRKGPEALGKVSLPLCDFKRFLTCGTKLLYLWTSSHTNSVPGTVTKKGYVMERIVLQVDFPSPAFDIIYTTPQVDRSIIQQHNLETLENDIKGKLLDILHKDSSLGLSKEDKAFLWEKRYYCFKHPNCLPKILASAPNWKWVNLAKTYSLLHQWPALYPLIALELLDSKFADQEVRSLAVTWIEAISDDELTDLLPQFVQALKYEIYLNSSLVQFLLSRALGNIQIAHNLYWLLKDALHDVQFSTRYEHVLGALLSVGGKRLREELLKQTKLVQLLGGVAEKVRQASGSARQVVLQRSMERVQSFFQKNKCRLPLKPSLVAKELNIKSCSFFSSNAVPLKVTMVNADPMGEEINVMFKVGEDLRQDMLALQMIKIMDKIWLKEGLDLRMVIFKCLSTGRDRGMVELVPASDTLRKIQVEYGVTGSFKDKPLAEWLRKYNPSEEEYEKASENFIYSCAGCCVATYVLGICDRHNDNIMLRSTGHMFHIDFGKFLGHAQMFGSFKRDRAPFVLTSDMAYVINGGEKPTIRFQLFVDLCCQAYNLIRKQTNLFLNLLSLMIPSGLPELTSIQDLKYVRDALQPQTTDAEATIFFTRLIESSLGSIATKFPLKPSGT

SEQ ID NO: 819924 - protein, 483 aa, Homo sapiens
MAQISSNSGFKECPSSHPEPTRAKDVDKEEALQMEAEALAKLQKDRQVTDNQRGFELSSSTRKKAQVYNKQDYDLMVFPESDSQKRALDIDVEKLTQAELEKLLLDDSFETKKTPVLPVTPILSPSFSAQLYFRPTIQRGQWPPGLPGPSTYALPSIYPSTYSKQAAFQNGFNPRMPTFPSTEPIYLSLPGQSPYFSYPLTPATPFHPQGSLPIYRPVVSTDMAKLFDKIASTSEFLKNGKARTDLEITDSKVSNLQVSPKSEDISKFDWLDLDPLSKPKVDNVEVLDHEEEKNVSSLLAKDPWDAVLLEERSTANCHLERKVNGKSLSVATVTRSQSLNIRTTQLAKAQGHISQKDPNGTSSLPTGSSLLQEVEVQNEEMAAFCRSITKLKTKFPYTNHRTNPGYLLSPVTAQRNICGENASVKVSIDIEGFQLPVTFTCDVSSTVEIIIMQALCWVHDDLNQVDVGSYVLKVCGQEEVLQK

SEQ ID NO: 819925 - protein, 556 aa, Homo sapiens
AIKDHAPQSTLSSSATQSCNLSLAMAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 819926 - protein, 136 aa, Homo sapiens
AIKDHAPQSTLSSSATQSCNLSLAMAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYCE

SEQ ID NO: 819927 - protein, 556 aa, Homo sapiens; identical to SEQ ID NO: 819925

SEQ ID NO: 819928 - protein, 556 aa, Homo sapiens; identical to SEQ ID NO: 819925

SEQ ID NO: 819929 - protein, 374 aa, Homo sapiens
AIKDHAPQSTLSSSATQSCNLSLAMAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAHSC

SEQ ID NO: 819930 - protein, 556 aa, Homo sapiens; identical to SEQ ID NO: 819925

SEQ ID NO: 819931 - protein, 504 aa, Homo sapiens
AIKDHAPQSTLSSSATQSCNLSLAMAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTREPPGMRLSSSLW

SEQ ID NO: 819932 - protein, 442 aa, Homo sapiens
MCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 819933 - protein, 529 aa, Homo sapiens
MVQDPRQADRLWSARALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 819934 - protein, 503 aa, Homo sapiens
YKGSRAPVDAELLCYSELQPQPRYGSQQPPARAARTPGPARGSVPRTWQCPDICVPLKSHPAPGRLRADGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 819935 - protein, 86 aa, Homo sapiens
TVKCEAHPRAKVTLNGVPAQPLGPRAQLLLKATPEDNGRSFSCSATLEVAGQLIHKNQTRELRVLCEWGCWSMAPIPQGPISLKVP

SEQ ID NO: 819936 - protein, 166 aa, Homo sapiens
MSEPQPRGAERDLYRDTWVRYLGYANEVGEAFRSLVPAAVVWLSYGVASSYVLADAIDKGKKAGEVPSPEAGRSARVTVAVVDTFVWQALASVAIPGFTINRVCAASLYVLGTATRWPLAVRKWTTTALGLLTIPIIIHPIDRSVDFLLDSSLRKLYPTVGKPSSS

SEQ ID NO: 819937 - protein, 217 aa, Homo sapiens
HNGPRYEAGFPDLSFGAGLSAGPGRADPSAGGGDCSGASTGCSGRGRGGRVMSEPQPRGAERDLYRDTWVRYLGYANEVGEAFRSLVPAAVVWLSYGVASSYVLADAIDKGKKAGEVPSPEAGRSARVTVAVVDTFVWQALASVAIPGFTINRVCAASLYVLGTATRWPLAVRKWTTTALGLLTIPIIIHPIDRSVDFLLDSSLRKLYPTVGKPSSS

SEQ ID NO: 819938 - protein, 166 aa, Homo sapiens; identical to SEQ ID NO: 819936

SEQ ID NO: 819939 - protein, 166 aa, Homo sapiens; identical to SEQ ID NO: 819936

SEQ ID NO: 819940 - protein, 232 aa, Homo sapiens
TFVLWYEALVCVTSVSFVAAVFLCGSRLGVRTAVCQGFGLSVRCDATLPGVFVRQRVPLRGVKKSVLHEPQPRGAERDLYRDTWVRYLGYANEVGEAFRSLVPAAVVWLSYGVASSYVLADAIDKGKKAGEVPSPEAGRSARVTVAVVDTFVWQALASVAIPGFTINRVCAASLYVLGTATRWPLAVRKWTTTALGLLTIPIIIHPIDRSVDFLLDSSLRKLYPTVGKPSSS

SEQ ID NO: 819941 - protein, 166 aa, Homo sapiens; identical to SEQ ID NO: 819936

SEQ ID NO: 819942 - protein, 166 aa, Homo sapiens; identical to SEQ ID NO: 819936

SEQ ID NO: 819943 - protein, 143 aa, Homo sapiens
MSEPQPRGAERDLYRDTWVRYLGYANEVGEAFRSLVPAAVVWLSYGVASSYVLADAIDKGKKAGEALASVAIPGFTINRVCAASLYVLGTATRWPLAVRKWTTTALGLLTIPIIIHPIDRSVDFLLDSSLRKLYPTVGKPSSS

SEQ ID NO: 819944 - protein, 147 aa, Homo sapiens
MWQTVPHSWVRTSPLATCPSRSSLVPLVAGFSASAPAGLSVSAPTRVPSPEAGRSARVTVAVVDTFVWQALASVAIPGFTINRVCAASLYVLGTATRWPLAVRKWTTTALGLLTIPIIIHPIDRSVDFLLDSSLRKLYPTVGKPSSS

SEQ ID NO: 819945 - protein, 135 aa, Homo sapiens
MSEPQPRGAERDLYRDTWVRYLGYANEVGEAFRSLVPAAVVWLSYGVASSYVLADAIDKGKKAGEVGGFPPGLQPAQALPNSGEAQLLLIILWYLACASASCFMSTSYSCQGMWTPGSLVSKDPGTWVGLSWTEA

SEQ ID NO: 819946 - protein, 199 aa, Homo sapiens
MSEPQPRGAERDLYRDTWVRYLGYANEVGEAFRSLVPAAVVWLSYGVASSYVLADAIDKGKKAGEVPSPEAGRSARVTVAVVDTFVWQALASVAIPGFTINRVCAASLYVLGTATRWPLAVRKWTTTALGLLTIPSRGKDFPREPLSVTWSESGQGVTARNFPPSQDASGDLYTTSSQLTLPATQCLAGKSVTCHVKHY

SEQ ID NO: 819947 - protein, 77 aa, Homo sapiens
TLGLGSRRDGTREKGVEETPVRARTFQVKRGHISVPHFLTQTSFHCCQQQSPNIAAEEKNCIAFCLLQASSTVTGGT

SEQ ID NO: 819948 - protein, 630 aa, Homo sapiens
GTRRLSAPAAAMAAAPPLSKAEYLKRYLSGADAGVDRGSESGRKRRKKRPKPGGAGGKGMRIVDDDVSWTAISTTKLEKEEEEDDGDLPVVAEFVDERPEEVKQMEAFRSSAKWKLLGGHNEDLPSNRHFRHDTPDSSPRRVRHGTPDPSPRKDRHDTPDPSPRRARHDTPDPSPLRGARHDSDTSPPRRIRHDSSDTSPPRRARHDSPDPSPPRRPQHNSSGASPRRVRHDSPDPSPPRRARHGSSDISSPRRVHNNSPDTSRRTLGSSDTQQLRRARHDSPDLAPNVTYSLPRTKSGKAPERASSKTSPHWKESGASHLSFPKNSKYEYDPDISPPRKKQAKSHFGDKKQLDSKGDCQKATDSDLSSPRHKQSPGHQDSDSDLSPPRNRPRHRSSDSDLSPPRRRQRTKSSDSDLSPPRRSQPPGKKAAHMYSGAKTGLVLTDIQREQQELKEQDQETMAFEAEFQYAETVFRDKSGRKRNLKLERLEQRRKAEKDSERDELYAQWGKGLAQSRQQQQNVEDAMKEMQKPLARYIDDEDLDRMLREQEREGDPMANFIKKNKAKENKNKKVRPRYSGPAPPPNRFNIWPGYRWDGVDRSNGFEQKRFARLASKKAVEELAYKWSVEDM

SEQ ID NO: 819949 - protein, 449 aa, Homo sapiens
MVPQIHLLGRTVMTPRIHLLGGARHDSPDPSPPRRPQHNSSGASPRRVRHDSPDPSPPRRARHGSSDISSPRRVHNNSPDTSRRTLGSSDTQQLRRARHDSPDLAPNVTYSLPRTKSGKAPERASSKTSPHWKESGASHLSFPKNSKYEYDPDISPPRKKQAKSHFGDKKQLDSKGDCQKATDSDLSSPRHKQSPGHQDSDSDLSPPRNRPRHRSSDSDLSPPRRRQRTKSSDSDLSPPRRSQPPGKKAAHMYSGAKTGLVLTDIQREQQELKEQDQETMAFEAEFQYAETVFRDKSGRKRNLKLERLEQRRKAEKDSERDELYAQWGKGLAQSRQQQQNVEDAMKEMQKPLARYIDDEDLDRMLREQEREGDPMANFIKKNKAKENKNKKVRPRYSGPAPPPNRFNIWPGYRWDGVDRSNGFEQKRFARLASKKAVEELAYKWSVEDM

SEQ ID NO: 819950 - protein, 215 aa, Homo sapiens
MNDQGEIYSTLRFLQSPSESQNRLRPDDTQRPGKTDDKEFSVPWHLIAVTLGILCLLLLMIVTVLVTNIFQCIQEKHQRQEILRNCSEKYIMQNDNYLKEQILTNKTLKYDVLKNSFQQKKELDSRLIQKNRCHRENEIVFKVLQNTGKFSEDHGSCCGVNCYYFTMQKKDWKGCKQTCQHCRSSLLKIDDKDELVFYIHFYSLGLCFSMLDLRY

SEQ ID NO: 819951 - protein, 238 aa, Homo sapiens
MLCCMRRTKQVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIEAVDETKPKESARQDEGKEEEPEADQEHA

SEQ ID NO: 819952 - protein, 238 aa, Homo sapiens; identical to SEQ ID NO: 819951

SEQ ID NO: 819953 - protein, 238 aa, Homo sapiens; identical to SEQ ID NO: 819951

SEQ ID NO: 819954 - protein, 238 aa, Homo sapiens; identical to SEQ ID NO: 819951

SEQ ID NO: 819955 - protein, 288 aa, Homo sapiens
DSEDPRATARSGVEKKGEGTTTSEAVERGGIRKREKERREGRKKARDETTMLCCMRRTKQVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIEAVDETKPKESARQDEGKEEEPEADQEHA

SEQ ID NO: 819956 - protein, 303 aa, Homo sapiens
MISWCAAFLSPSEKRSIRVGGTGFSSEMNPVPQMEMQKSPVFCALTLGAVDRSCSYSAILAPPDIRCFTIKYDIAVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIEAVDETKPKESARQDEGKEEEPEADQEHA

SEQ ID NO: 819957 - protein, 274 aa, Homo sapiens
MTKSCSELCHPALHFLPCLGGLRKNLQRAVRPSPYSLGFLTFWISRVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIEAVDETKPKESARQDEGKEEEPEADQEHA

SEQ ID NO: 819958 - protein, 404 aa, Homo sapiens
MVRGLGGRLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLESWRRNFAAVTLLCQLGGTLSQRCGLEVPPGGRLPKGRLRGMPVVPPPPPQCRGISPPGRRREQVVPRLGAPGVLSATNEENTEHTWEERHRVREPAPIVVGPPPPPVIGGWFEKLAIVERQAGGRHMFICSHWY

SEQ ID NO: 819959 - protein, 134 aa, Homo sapiens
GKVETMDTVVGTQRGRGRKGSSIRNKGAPTRKAFCKKERNGGEDVRDHPHPHSCRSISHPEGLRRGSCGPRLGGAQLGLLAPHEPRPSLPPALCLGDSGLHSGGHHGDPGHLSIACGGHPSTPTPKCLRSVFIP

SEQ ID NO: 819960 - protein, 949 aa, Homo sapiens
PEPGSGSRDPGPGIAEPDLGRPAGHLRADTSPAEPREMEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 819961 - protein, 949 aa, Homo sapiens; identical to SEQ ID NO: 819960

SEQ ID NO: 819962 - protein, 1009 aa, Homo sapiens
PEPGSGSRDPGPGIAEPDLGRPAGHLRADTSPAEPREMEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESSGSRLSGRLGRSESLRVSDRRRPSRGSLGAKGRGGGRSRSDVDMDPSSATAVLGPARRATPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 819963 - protein, 916 aa, Homo sapiens
PEPGSGSRDPGPGIAEPDLGRPAGHLRADTSPAEPREMEDFARGAASPGPSRPGLVPVSIIGAEDEDFENELETNSEEQNSQFQSLEQVKRRPAHLMALLQHVALQFEPGPLVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 819964 - protein, 576 aa, Homo sapiens
SLEIPWSRTLTGVERSKRLKAASWDGPSWGPNKASVHSPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 819965 - protein, 816 aa, Homo sapiens
PEPGSGSRDPGPGIAEPDLGRPAGHLRADTSPAEPREMEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSR

SEQ ID NO: 819966 - protein, 1003 aa, Homo sapiens
PEPGSGSRDPGPGIAEPDLGRPAGHLRADTSPAEPREMEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKGVGGGILPPETPPVSAWGELCPPAWLHLRFPPRKAFCKKERNGGEDVRDHPHPHSCRSISHPEGLRRGSCGPRLGGAQLGLLAPHEPRPSLPPALCLGDSGLHSGGHHGDPGHLSIACGGHPSTPTPKCLRSVFIP

SEQ ID NO: 819967 - protein, 887 aa, Homo sapiens
PEPGSGSRDPGPGIAEPDLGRPAGHLRADTSPAEPREMEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKGSPALPLQGGHQPKQCLCSN

SEQ ID NO: 819968 - protein, 515 aa, Homo sapiens
KASRGRVEIGRGLPRVPGEAEEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 819969 - protein, 279 aa, Homo sapiens
MLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 819970 - protein, 550 aa, Homo sapiens
PEPGSGSRDPGPGIAEPDLGRPAGHLRADTSPAEPREMEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETERCPGWGAGAGGVAYWALVGGCRVTAAICACLSQALAPHAPLLLSGSGHSSPFFFPFLISLLLPHCPPFLLSFLFPLLLPLLPFFTNPSPPPFLSTTPSISFISPSSLTSPLLSHLPHPLSPPPSSLTYPTRLKDPQSTNS

SEQ ID NO: 819971 - protein, 480 aa, Homo sapiens
PEPGSGSRDPGPGIAEPDLGRPAGHLRADTSPAEPREMEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETERCPGWGAGAGGVAYWALVGGCRVTAAICACLSQALAPHAPLLLSGSGHSSPFFFPFLISLPQDPPLPQCP

SEQ ID NO: 819972 - protein, 453 aa, Homo sapiens
PEPGSGSRDPGPGIAEPDLGRPAGHLRADTSPAEPREMEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETERCPGWGAGAGGVAYWALVGGCRVTAAICACLSQALAPHAPLLL

SEQ ID NO: 819973 - protein, 131 aa, Homo sapiens
PEPGSGSRDPGPGIAEPDLGRPAGHLRADTSPAEPREMEDFARGAASPGPSRPGLVPVSIIGAEDEDFENELETNSEEQNSQFQSLEQVKRRPAHLMALLQHVALQFEPGPLVRAGLGGHREGWGWDRHSF

SEQ ID NO: 819974 - protein, 152 aa, Homo sapiens
CPGHPCPGPGLSLSLSLSWSLPVSVPVLVSPQFLSLPWPLPTSVPALVSPRLCPCPGFSSSLFLSWSLLVSVPGICLTLSLASGSRLSGRLGRSESLRVSDRRRPSRGSLGAKGRGGGRSRSDVDMDPSSATAVLGPARRATYVNPLPSPIH

SEQ ID NO: 819975 - protein, 82 aa, Homo sapiens
MPSRDRNIGAPGQDTPGVSLHPLSLDSPDREPGESFLGQGSMRPGDPGWGCCLPPWHPQIEAIPQQHLPFALSIHFSLLLVT

SEQ ID NO: 819976 - protein, 853 aa, Homo sapiens
MALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 819977 - protein, 121 aa, Homo sapiens
SPCLSLHLSPSPLFSYIPQAFCKKERNGGEDVRDHPHPHSCRSISHPEGLRRGSCGPRLGGAQLGLLAPHEPRPSLPPALCLGDSGLHSGGHHGDPGHLSIACGGHPSTPTPKCLRSVFIP

SEQ ID NO: 819978 - protein, 70 aa, Homo sapiens
GEFVVLLGEFVVLLGEFVVLLGEFVVLLRRIRGAADPGLPQHPRLDQGSWQSSRPASQHTKSSSSPHSLS

SEQ ID NO: 819979 - protein, 945 aa, Homo sapiens
GVGRVRSPSAEASVPVAAMASLSTWSSPAEPREMEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 819980 - protein, 916 aa, Homo sapiens; identical to SEQ ID NO: 819963

SEQ ID NO: 819981 - protein, 949 aa, Homo sapiens; identical to SEQ ID NO: 819960

SEQ ID NO: 819982 - protein, 949 aa, Homo sapiens; identical to SEQ ID NO: 819960

SEQ ID NO: 819983 - protein, 769 aa, Homo sapiens
PEPGSGSRDPGPGIAEPDLGRPAGHLRADTSPAEPREMEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATAGVLSSLRLPDP

SEQ ID NO: 819984 - protein, 297 aa, Homo sapiens
MVRGLGGRLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 819985 - protein, 262 aa, Homo sapiens
MHVCAYMCVCTQVCDCACIYSVCMHACVRVHVCACMVCVYAYVCMRVTACACMCVCVRMCRPHHCPVCLLSPGLCVFHCLGLSVSLSPGLDLCLCLRTSCLPTSSSLSPCPCGPPGPGVWGHPALPPLSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 819986 - protein, 245 aa, Homo sapiens
IEDRDVFRKRLNIESSKGWWLQKRDVGTQEQHVHACVCVCACADPTTAPSVSCLQASVSSIVWASLSPCLPASTSVSVSGPPCLPTSSSLSPCPCGPPGPGVWGHPALPPLSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 819987 - protein, 131 aa, Homo sapiens; identical to SEQ ID NO: 819973

SEQ ID NO: 819988 - protein, 278 aa, Homo sapiens
MVSNPVHGLPFLPGTSFKDSTKTAFHRSQTLSYRNGYAIVRRPTVGIGGDRLQFNQLSQAELDELASKAPVLTYGQPKQAPPADFIPAHVAFDKKVLKFDAYFQEDVPMSTEEQYRIRQVNIYYYLEDDSMSVIEPVVENSGILQGKLIKRQRLAKNDRGDHYHWKDLNRGINITIYGKTFRVVDCDQFTQVFLESQGIELNPPEKMALDPYTELRKQPLRKYVTPSDFDQLKQFLTFDKQVSDIGTTIGLLISKCDLHLLAKGLGSCIGNYFETLQL

SEQ ID NO: 819989 - protein, 640 aa, Homo sapiens
MVSNPVHGLPFLPGTSFKDSTKTAFHRSQTLSYRNGYAIVRRPTVGIGGDRLQFNQLSQAELDELASKAPVLTYGQPKQAPPADFIPAHVAFDKKVLKFDAYFQEDVPMSTEEQYRIRQVNIYYYLEDDSMSVIEPVVENSGILQGKLIKRQRLAKNDRGDHYHWKDLNRGINITIYGKTFRVVDCDQFTQVFLESQGIELNPPEKMALDPYTELRKQPLRKYVTPSDFDQLKQFLTFDKQVLRFYAIWDDTDSMYGECRTYIIHYYLMDDTVEIREVHERNDGRDPFPLLMNRQRVPKVLVENAKNFPQCVLEISDQEVLEWYTAKDFIVGKSLTILGRTFFIYDCDPFTRRYYKEKFGITDLPRIDVSKREPPPVKQELPPYNGFGLVEDSAQNCFALIPKAPKKDVIKMLVNDNKVLRYLAVLESPIPEDKDRRFVFSYFLATDMISIFEPPVRNSGIIGGKYLGRTKVVKPYSTVDNPVYYGPSDFFIGAVIEVFGHRFIILDTDEYVLKYMESNAAQYSPEALASIQNHVRKREAPAPEAESKQTEKDPGVQELEALIDTIQKQLKDHSCKDNIREAFQIYDKEASGYVDRDMFFKICESLNVPVDDSLVKELIRMCSHGEGKINYYNFVRAFSN

SEQ ID NO: 819990 - protein, 640 aa, Homo sapiens; identical to SEQ ID NO: 819989

SEQ ID NO: 819991 - protein, 170 aa, Homo sapiens [sequence omitted]

SEQ ID NO: 819992 - protein, 278 aa, Homo sapiens; identical to SEQ ID NO: 819988

SEQ ID NO: 819993 - protein, 640 aa, Homo sapiens; identical to SEQ ID NO: 819989

SEQ ID NO: 819994 - protein, 640 aa, Homo sapiens; identical to SEQ ID NO: 819989

SEQ ID NO: 819995 - protein, 278 aa, Homo sapiens; identical to SEQ ID NO: 819988

SEQ ID NO: 819996 - protein, 278 aa, Homo sapiens; identical to SEQ ID NO: 819988

SEQ ID NO: 819997 - protein, 278 aa, Homo sapiens; identical to SEQ ID NO: 819988

SEQ ID NO: 819998 - protein, 106 aa, Homo sapiens
KPLQTQRNYGPPVRPRMGPERTGAAPLPLLLVLALSQGKRGFRSASAAGGTRAASWGSLEGLGGTRERAPCVPSDSTWTRAPSHQDLLGKRYFFVPFLLSQALRPH

SEQ ID NO: 819999 - protein, 1197 aa, Homo sapiens
KPLQTQRNYGPPVRPRMGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 820000 - protein, 1197 aa, Homo sapiens; identical to SEQ ID NO: 819999

SEQ ID NO: 820001 - protein, 1197 aa, Homo sapiens; identical to SEQ ID NO: 819999

SEQ ID NO: 820002 - protein, 1197 aa, Homo sapiens; identical to SEQ ID NO: 819999

SEQ ID NO: 820003 - protein, 1197 aa, Homo sapiens; identical to SEQ ID NO: 819999

SEQ ID NO: 820004 - protein, 665 aa, Homo sapiens
KPLQTQRNYGPPVRPRMGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWS

SEQ ID NO: 820005 - protein, 120 aa, Homo sapiens
MGPRPAHCVTWKNTASWSSPPPLSPWSSCKSARMSQAEFEKAAEEVRHLKTKPSDEEMLFIYGHYKQATVGDINTERPGMLDFTGKAKWDAWNELKGTSKEDAMKAYINKVEELKKKYGI

SEQ ID NO: 820006 - protein, 87 aa, Homo sapiens
MSQAEFEKAAEEVRHLKTKPSDEEMLFIYGHYKQATVGDINTERPGMLDFTGKAKWDAWNELKGTSKEDAMKAYINKVEELKKKYGI

SEQ ID NO: 820007 - protein, 87 aa, Homo sapiens; identical to SEQ ID NO: 820006

SEQ ID NO: 820008 - protein, 87 aa, Homo sapiens; identical to SEQ ID NO: 820006

SEQ ID NO: 820009 - protein, 87 aa, Homo sapiens; identical to SEQ ID NO: 820006

SEQ ID NO: 820010 - protein, 87 aa, Homo sapiens; identical to SEQ ID NO: 820006

SEQ ID NO: 820011 - protein, 189 aa, Homo sapiens
MSQAEFEKAAEEVRHLKTKPSDEEMLFIYGHYKQATVGDINTERPGMLDFTGKAKWDAWNELKGTSKEDAMKAYINKVEELKKKKKKKKKKNLGAALGLWKRFFSPFRWARARGPKCGAQWAPSWANKRVVHTEGRHRGAHDTQRGGDFFPNFKKTGRVGTPRSGFRDQNPQEGGAQRANHGASIQPRG

SEQ ID NO: 820012 - protein, 87 aa, Homo sapiens; identical to SEQ ID NO: 820006

SEQ ID NO: 820013 - protein, 87 aa, Homo sapiens; identical to SEQ ID NO: 820006

SEQ ID NO: 820014 - protein, 87 aa, Homo sapiens; identical to SEQ ID NO: 820006

SEQ ID NO: 820015 - protein, 104 aa, Homo sapiens
MWGDLWLLPPASANPGTGTEAEFEKAAEEVRHLKTKPSDEEMLFIYGHYKQATVGDINTERPGMLDFTGKAKWDAWNELKGTSKEDAMKAYINKVEELKKKYGI

SEQ ID NO: 820016 - protein, 104 aa, Homo sapiens; identical to SEQ ID NO: 820015

SEQ ID NO: 820017 - protein, 169 aa, Homo sapiens
GGDQRAPALTPRHSCPVPFQLFPAYCAPSVLRPGLRCSPGHSLVPGPVVARQLAALLLPQRGPPLGAKAWPALFTAVFPDLMPAFAEFEKAAEEVRHLKTKPSDEEMLFIYGHYKQATVGDINTERPGMLDFTGKAKWDAWNELKGTSKEDAMKAYINKVEELKKKYGI

SEQ ID NO: 820018 - protein, 124 aa, Homo sapiens
MGEGVARIGGGEETQSPSRSTGQDVAAEWGSEESVAESLEAEFEKAAEEVRHLKTKPSDEEMLFIYGHYKQATVGDINTERPGMLDFTGKAKWDAWNELKGTSKEDAMKAYINKVEELKKKYGI

SEQ ID NO: 820019 - protein, 117 aa, Homo sapiens
HSWMISMCLDLLIGQYFFLVVPGDLERSDRMSQAEFEKAAEEVRHLKTKPSDEEMLFIYGHYKQATVGDINTERPGMLDFTGKAKWDAWNELKGTSKEDAMKAYINKVEELKKKYGI

SEQ ID NO: 820020 - protein, 87 aa, Homo sapiens; identical to SEQ ID NO: 820006

SEQ ID NO: 820021 - protein, 87 aa, Homo sapiens; identical to SEQ ID NO: 820006

SEQ ID NO: 820022 - protein, 87 aa, Homo sapiens; identical to SEQ ID NO: 820006

SEQ ID NO: 820023 - protein, 69 aa, Homo sapiens
TNERRGFCVITYTDEEPVKKLLSTERPGMLDFTGKAKWDAWNELKGTSKEDAMKAYINKVEELKKKYGI

SEQ ID NO: 820024 - protein, 104 aa, Homo sapiens; identical to SEQ ID NO: 820015

SEQ ID NO: 820025 - protein, 142 aa, Homo sapiens
MIIKREYDSYSAYTSLCGINALFKLASWSSPPPLSPWSSCKSARMSQAEFEKAAEEVRHLKTKPSDEEMLFIYGHYKQATVGDINTERPGMLDFTGKAKWDAWNELKGTSKEDAMKAYINKVEELKNALFFSNTVDGGNSGK

SEQ ID NO: 820026 - protein, 77 aa, Homo sapiens
ESKQCPESKQCSESKQCPESKQCRETGQARGSEDKPHTHSRGRKQTPHEGSHLLLLGSIYFQHLFDAVFNPLPIALL

SEQ ID NO: 820027 - protein, 77 aa, Homo sapiens; identical to SEQ ID NO: 820026

SEQ ID NO: 820028 - protein, 77 aa, Homo sapiens; identical to SEQ ID NO: 820026

SEQ ID NO: 820029 - protein, 77 aa, Homo sapiens; identical to SEQ ID NO: 820026

SEQ ID NO: 820030 - protein, 899 aa, Homo sapiens
SVYLERLKILRQRCGLDNTKQDDRPPLTSLLSKPAVPTVASSTDMLHSKLSQLRESREQHQHSDLDSNQTHSSGGSRGAWRGREGGTCWGNELGKTERALCRAGGRRGGQRPQPGGRGRMEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMISSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 820031 - protein, 873 aa, Homo sapiens
RGERRLRLRLRLLAGGGGEEEPGRGGRASGELAVFLRRSRRLGRWGGGGSRGAWRGREGGTCWGNELGKTERALCRAGGRRGGQRPQPGGRGRMEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMISSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 820032 - protein, 761 aa, Homo sapiens
GVQIVADRENGGIERLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMISSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 820033 - protein, 697 aa, Homo sapiens
MLKRTDTRTYCHGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMISSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 820034 - protein, 472 aa, Homo sapiens
SVYLERLKILRQRCGLDNTKQDDRPPLTSLLSKPAVPTVASSTDMLHSKLSQLRESREQHQHSDLDSNQTHSSGGSRGAWRGREGGTCWGNELGKTERALCRAGGRRGGQRPQPGGRGRMEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVSLKNKILLLQNHQGPAVALLKGMLKKKYCSHRNLIQCHPS

SEQ ID NO: 820035 - protein, 665 aa, Homo sapiens
MLKRTDTRTYCHIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMISSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 820036 - protein, 650 aa, Homo sapiens
MACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMISSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 820037 - protein, 916 aa, Homo sapiens
SVYLERLKILRQRCGLDNTKQDDRPPLTSLLSKPAVPTVASSTDMLHSKLSQLRESREQHQHSDLDSNQTHSSGGSRGAWRGREGGTCWGNELGKTERALCRAGGRRGGQRPQPGGRGRMEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMISSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQELYTQYYTNDARWPHVFVGPTSYLNEAILGNVTRKRDLLILIRVCLESKLLVMELTALQRAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 820038 - protein, 899 aa, Homo sapiens; identical to SEQ ID NO: 820030

SEQ ID NO: 820039 - protein, 899 aa, Homo sapiens; identical to SEQ ID NO: 820030

SEQ ID NO: 820040 - protein, 899 aa, Homo sapiens; identical to SEQ ID NO: 820030

SEQ ID NO: 820041 - protein, 856 aa, Homo sapiens
SVYLERLKILRQRCGLDNTKQDDRPPLTSLLSKPAVPTVASSTDMLHSKLSQLRESREQHQHSDLDSNQTHSSGGSRGAWRGREGGTCWGNELGKTERALCRAGGRRGGQRPQPGGRGRMEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMISSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDQQQEYPRRSRDA

SEQ ID NO: 820042 - protein, 792 aa, Homo sapiens
SVYLERLKILRQRCGLDNTKQDDRPPLTSLLSKPAVPTVASSTDMLHSKLSQLRESREQHQHSDLDSNQTHSSGGSRGAWRGREGGTCWGNELGKTERALCRAGGRRGGQRPQPGGRGRMEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMISSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKGNNIVSNT

SEQ ID NO: 820043 - protein, 675 aa, Homo sapiens
SVYLERLKILRQRCGLDNTKQDDRPPLTSLLSKPAVPTVASSTDMLHSKLSQLRESREQHQHSDLDSNQTHSSGGSRGAWRGREGGTCWGNELGKTERALCRAGGRRGGQRPQPGGRGRMEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMISSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAITIKPLVYRQMK

SEQ ID NO: 820044 - protein, 363 aa, Homo sapiens
SVYLERLKILRQRCGLDNTKQDDRPPLTSLLSKPAVPTVASSTDMLHSKLSQLRESREQHQHSDLDSNQTHSSGGSRGAWRGREGGTCWGNELGKTERALCRAGGRRGGQRPQPGGRGRMEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCRYKRISQVYKYII

SEQ ID NO: 820045 - protein, 380 aa, Homo sapiens
SVYLERLKILRQRCGLDNTKQDDRPPLTSLLSKPAVPTVASSTDMLHSKLSQLRESREQHQHSDLDSNQTHSSGGSRGAWRGREGGTCWGNELGKTERALCRAGGRRGGQRPQPGGRGRMEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGREDEQARTDYFIRTLLLEFQNESRRLYQFHYVNWPDHDVPSSFDSILDMISLMRKYQEHEDVPICIHCSAGCGRTGAICAIDYTWNLLKAGKIPEDLLSLIQYRNGNTRVLEDEQGHMIVIE

SEQ ID NO: 820046 - protein, 235 aa, Homo sapiens
SVYLERLKILRQRCGLDNTKQDDRPPLTSLLSKPAVPTVASSTDMLHSKLSQLRESREQHQHSDLDSNQTHSSGGSRGAWRGREGGTCWGNELGKTERALCRAGGRRGGQRPQPGGRGRMEQVEILRKFIQRVQAMKSPDHNGEDNFARDFMRLRRLSTKYRTEKIYPTATGEKEENVKKNRYKDILPFDHSRVKLTLKTPSQDSDYINANFIKVCTNFKWCFSAILMSFYILVL

SEQ ID NO: 820047 - protein, 116 aa, Homo sapiens
MLLGRLTSQLLRAVPWAGGRPPWPVSGVLGSRVCGPLYSTSPAGPGRAASLPRKGAQLELEEMLVPRKMSVSPLESWLTARCFLPRLDTGTAGTCGSTAILPVSAQPDRGRGRAGG

SEQ ID NO: 820048 - protein, 92 aa, Homo sapiens
MVRLKIRKLSSTLGGHGYRAGVVPAVLLYQVFYTSTNEKPAVWWGFQRRGNSFFPGERAAVTHRRDIPELPARGPVLVLAKVPVTAATDTSC

SEQ ID NO: 820049 - protein, 116 aa, Homo sapiens; identical to SEQ ID NO: 820047

SEQ ID NO: 820050 - protein, 116 aa, Homo sapiens; identical to SEQ ID NO: 820047

SEQ ID NO: 820051 - protein, 611 aa, Homo sapiens
GSRRHKMAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEVRLPPALHSQRSMLRVKRFVTLPGYKGSEYLPPSLSSVPEEFCFLTFFFPWVHLPFGLNSPQAFGGRQDAVAGDKHGRVAMLPLQHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWNYMNDSLRTDVFVRFQPESIACACIYLAARTLEIPLPNRPHWFLLFGATEEEIQEICLKILQLYARKKVDLTHLEGEVEKRKHAIEEAKAQARGLLPGGTQVLDGTSGFSPAPKLVESPKEGKGSKPSPLSVKNTKRRLEGAKKAKADSPVNGLPKGRESRSRSRSREQSYSRSPSRSASPKRRKSDSGSTSGGSKSQSRSRSRSDSPPRQAPRSAPYKGSEIRGSRKSKDCKYPQKPHKSRSRSSSRSRSRSRERADNPGKYKKKSHYYRDQRRERSRSYERTGRRYERDHPGHSRHRR

SEQ ID NO: 820052 - protein, 611 aa, Homo sapiens; identical to SEQ ID NO: 820051

SEQ ID NO: 820053 - protein, 454 aa, Homo sapiens
GSRRHKMAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEVRLPPALHSQRSMLRVKRFVTLPGYKGSEYLPPSLSSVPEEFCFLTFFFPWVHLPFGLNSPQAFGGRQDAVAGDKHGRVAMLPLQHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWNYMNDSLRTDVFVRFQPESIACACIYLAARTLEIPLPNRPHWFLLFGATEEEIQEICLKILQLYARKKVDLTHLEGEVEKRKHAIEEAKAQARGLLPGGTQVLDGTSGFSPAPKLAWSAVALSGITASSAYQILVILVPQPPK

SEQ ID NO: 820054 - protein, 611 aa, Homo sapiens; identical to SEQ ID NO: 820051

SEQ ID NO: 820055 - protein, 611 aa, Homo sapiens; identical to SEQ ID NO: 820051

SEQ ID NO: 820056 - protein, 611 aa, Homo sapiens; identical to SEQ ID NO: 820051

SEQ ID NO: 820057 - protein, 611 aa, Homo sapiens; identical to SEQ ID NO: 820051

SEQ ID NO: 820058 - protein, 611 aa, Homo sapiens; identical to SEQ ID NO: 820051

SEQ ID NO: 820059 - protein, 611 aa, Homo sapiens; identical to SEQ ID NO: 820051

SEQ ID NO: 820060 - protein, 611 aa, Homo sapiens; identical to SEQ ID NO: 820051

SEQ ID NO: 820061 - protein, 611 aa, Homo sapiens; identical to SEQ ID NO: 820051

SEQ ID NO: 820062 - protein, 611 aa, Homo sapiens; identical to SEQ ID NO: 820051

SEQ ID NO: 820063 - protein, 611 aa, Homo sapiens; identical to SEQ ID NO: 820051

SEQ ID NO: 820064 - protein, 611 aa, Homo sapiens; identical to SEQ ID NO: 820051

SEQ ID NO: 820065 - protein, 738 aa, Homo sapiens
GSRRHKMAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEVRLPPALHSQRSMLRVKRFVTLPGYKGSEYLPPSLSSVPEEFCFLTFFFPWVHLPFGLNSPQAFGGRQDAVAGDKHGRVAMLPLQHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWNYMNDSLRTDVFVRFQPESIACACIYLAARTLEIPLPNRPHWFLLFGATEEEIQEICLKILQLYARKKVDLTHLEGEVEKRKHAIEEAKAQARGLLPGGTQVLDGTSGFSPAPKLVESPKEGKGSKPSPLSVKNTKRRLEGAKKAKADSPVNGLPKGRESRSRSRSREQSYSRSPSRSASPKRRKSDSGSTSGGSKSQSRSRSRSDSPPRQAPRSAPYKGSEIRGSRKSKDCKYPQKPHKSRSRSSSRSRSRSRERADNPGKYKKKSHYYRDQRRERSRSYERTGRRYERDHPGHSRHRSSPGTCGRRPQTMLLGRLTSQLLRAVPWAGGRPPWPVSGVLGSRVCGPLYSTSPAGPGRAASLPRKGAQLELEEMLVPRKMSVSPLESWLTARCFLPRLDTGTAGTCGSTAILPVSAQPDRGRGRAGG

SEQ ID NO: 820066 - protein, 738 aa, Homo sapiens; identical to SEQ ID NO: 820065

SEQ ID NO: 820067 - protein, 611 aa, Homo sapiens; identical to SEQ ID NO: 820051

SEQ ID NO: 820068 - protein, 611 aa, Homo sapiens; identical to SEQ ID NO: 820051

SEQ ID NO: 820069 - protein, 611 aa, Homo sapiens; identical to SEQ ID NO: 820051

SEQ ID NO: 820070 - protein, 611 aa, Homo sapiens; identical to SEQ ID NO: 820051

SEQ ID NO: 820071 - protein, 611 aa, Homo sapiens; identical to SEQ ID NO: 820051

SEQ ID NO: 820072 - protein, 611 aa, Homo sapiens; identical to SEQ ID NO: 820051

SEQ ID NO: 820073 - protein, 611 aa, Homo sapiens; identical to SEQ ID NO: 820051

SEQ ID NO: 820074 - protein, 611 aa, Homo sapiens; identical to SEQ ID NO: 820051

SEQ ID NO: 820075 - protein, 611 aa, Homo sapiens; identical to SEQ ID NO: 820051

SEQ ID NO: 820076 - protein, 611 aa, Homo sapiens; identical to SEQ ID NO: 820051

SEQ ID NO: 820077 - protein, 611 aa, Homo sapiens; identical to SEQ ID NO: 820051

SEQ ID NO: 820078 - protein, 611 aa, Homo sapiens; identical to SEQ ID NO: 820051

SEQ ID NO: 820079 - protein, 611 aa, Homo sapiens; identical to SEQ ID NO: 820051

SEQ ID NO: 820080 - protein, 152 aa, Homo sapiens
GSRRHKMAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEVRLPPALHSQRSMLRVKRFVTLPGY

SEQ ID NO: 820081 - protein, 152 aa, Homo sapiens; identical to SEQ ID NO: 820080

SEQ ID NO: 820082 - protein, 152 aa, Homo sapiens; identical to SEQ ID NO: 820080

SEQ ID NO: 820083 - protein, 162 aa, Homo sapiens
AAARLGPSLECWAAGSAGPFTAHRRPAQVGRPLSLARGPSWSWRRCWSPGRCPSAPWRAGSRPAASCPDWIPGPQGLVAPPQSYQCPPSQIGEGAEQGDEGVADAPSNSVQKRAEDPPAEDEPPQVPEAGEEDAVPAEEGPGGTPETQAGEWPPAWPWEGKV

SEQ ID NO: 820084 - protein, 105 aa, Homo sapiens
MLGKRFFGIFSCNVCVCVWPETPGSERTPSGFCRLISHTWRVKWKKESTLSKRQRPKPGACCLGAHRCWMVPRGSLLPPSWVSLLECRNPLPTKAKTGDSPPPPF

SEQ ID NO: 820085 - protein, 161 aa, Homo sapiens
MGCCYSSENEDSDQDREERKLLLDPSSPPTKALNGAEPNYHSLPSARTDEQALLSSILAKTASNIIDVSAADSQGMEQHEYMDRARQYSTRLAVLSSSLTHWKKLPPLPSLTSQPHQVLASEPIPFSDLQQVSRIAAYAYSALSQIRVDAKEELVVQFGIP

SEQ ID NO: 820086 - protein, 67 aa, Homo sapiens
ATYITKASDQSQVGVEFEASTRMQDTSVSFGYQLDLPKANLLFKGSVDSNWMGWGPKGQSLVCLHSH

SEQ ID NO: 820087 - protein, 121 aa, Homo sapiens
MGCCYSSENEDSDQDREERKLLLDPSSPPTKALNGAEPNYHSLPSARTDEQALLSSILAKTASNIIDVSAADSQGMEQHEYMDRARQYRHKGITLKRSCDLRVRSVGLGTSTATDLPLSQP

SEQ ID NO: 820088 - protein, 161 aa, Homo sapiens; identical to SEQ ID NO: 820085

SEQ ID NO: 820089 - protein, 161 aa, Homo sapiens; identical to SEQ ID NO: 820085

SEQ ID NO: 820090 - protein, 176 aa, Homo sapiens
WAGELRPAAGKTEELREAWRGALRSLALKDREERKLLLDPSSPPTKALNGAEPNYHSLPSARTDEQALLSSILAKTASNIIDVSAADSQGMEQHEYMDRARQYSTRLAVLSSSLTHWKKLPPLPSLTSQPHQVLASEPIPFSDLQQVSRIAAYAYSALSQIRVDAKEELVVQFGIP

SEQ ID NO: 820091 - protein, 172 aa, Homo sapiens
MEQHEYMTVPGQYSTRLAVLSQQPVPIGRSCPPLPSLTSQPHQVLASEPNYHSLPSARTDEQALLSSILAKTASNIIDVSAADSQGMEQHEYMDRARQYSTRLAVLSSSLTHWKKLPPLPSLTSQPHQVLASEPIPFSDLQQVSRIAAYAYSALSQIRVDAKEELVVQFGIP

SEQ ID NO: 820092 - protein, 111 aa, Homo sapiens
TRGSTHASAKTASNIIDVSAADSQGMEQHEYMDRARQYSTRLAVLSSSLTHWKKLPPLPSLTSQPHQVLASEPIPFSDLQQVSRIAAYAYSALSQIRVDAKEELVVQFGIP

SEQ ID NO: 820093 - protein, 142 aa, Homo sapiens
MGCCYSSENEDSDQDREERKLLLDPSSPPTKALNGAEPNYHSLPSARTDEQALLSSILAKTASNIIDVSAADSQGMEQHEYMDRARQYSTRLAVLSSSLTHWKKLPPLPSLTSQPHQVLASEPIPFSDLQQVQLFQSTPCSQ

SEQ ID NO: 820094 - protein, 184 aa, Homo sapiens
MGCCYSSENEDSDQDREERKLLLDPSSPPTKALNGAEPNYHSLPSARTDEQALLSSILAKTASNIIDVSAADSQGMEQHEYMDRARQYSTRLAVLSSSLTHWKKLPPLPSLTSQPHQVLASEPNYHSLPSARTDEQALLFFLLAKTASNIIDVSAADFTGHGSSMSTWDRARELQHPFGCAEEQ

SEQ ID NO: 820095 - protein, 998 aa, Homo sapiens
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 820096 - protein, 998 aa, Homo sapiens; identical to SEQ ID NO: 820095

SEQ ID NO: 820097 - protein, 100 aa, Homo sapiens
LNHVPKCSLYTPITNVPPEVTVLTNSPVELREPNVLICFIDKFTPPVVNVTWLRNGKPVTTGVSETVFLPREGLPCLLPFPVSIFLYFLSFYYHHAMPLE

SEQ ID NO: 820098 - protein, 155 aa, Homo sapiens
TFSFLLFLSVLPHSRALLTPNRAPKKKMAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNERYLGSPTGPVELVHGTWL

SEQ ID NO: 820099 - protein, 223 aa, Homo sapiens
TFSFLLFLSVLPHSRALLTPNRAPKKKMAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGFG

SEQ ID NO: 820100 - protein, 223 aa, Homo sapiens; identical to SEQ ID NO: 820099

SEQ ID NO: 820101 - protein, 223 aa, Homo sapiens; identical to SEQ ID NO: 820099

SEQ ID NO: 820102 - protein, 223 aa, Homo sapiens; identical to SEQ ID NO: 820099

SEQ ID NO: 820103 - protein, 223 aa, Homo sapiens; identical to SEQ ID NO: 820099

SEQ ID NO: 820104 - protein, 223 aa, Homo sapiens; identical to SEQ ID NO: 820099

SEQ ID NO: 820105 - protein, 223 aa, Homo sapiens; identical to SEQ ID NO: 820099

SEQ ID NO: 820106 - protein, 200 aa, Homo sapiens
CSVPAFTPWLPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGFG

SEQ ID NO: 820107 - protein, 223 aa, Homo sapiens; identical to SEQ ID NO: 820099

SEQ ID NO: 820108 - protein, 115 aa, Homo sapiens
WITHFNLIDTEEVEEDMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGFG

SEQ ID NO: 820109 - protein, 83 aa, Homo sapiens
DQARYRPPVELREPNVLICFIDKFTPPVVNVTWLRNGKPVTTGVSETVFLPREDHLFRKFHYLPFLPSTEDVYDCRVEHWGFG

SEQ ID NO: 820110 - protein, 223 aa, Homo sapiens; identical to SEQ ID NO: 820099

SEQ ID NO: 820111 - protein, 223 aa, Homo sapiens; identical to SEQ ID NO: 820099

SEQ ID NO: 820112 - protein, 223 aa, Homo sapiens; identical to SEQ ID NO: 820099

SEQ ID NO: 820113 - protein, 216 aa, Homo sapiens
TFSFLLFLSVLPHSRALLTPNRAPKKKMAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGTTFSASSTISPSCPQLRTFTTAGWSTGALDEPLLKHWEV

SEQ ID NO: 820114 - protein, 223 aa, Homo sapiens; identical to SEQ ID NO: 820099

SEQ ID NO: 820115 - protein, 159 aa, Homo sapiens
CSVPAFTPWLPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVHPTSGQCHVASKWKTCHHRSVRDSLPAQGRPPFPQVPLSPLPALN

SEQ ID NO: 820116 - protein, 223 aa, Homo sapiens; identical to SEQ ID NO: 820099

SEQ ID NO: 820117 - protein, 223 aa, Homo sapiens; identical to SEQ ID NO: 820099

SEQ ID NO: 820118 - protein, 223 aa, Homo sapiens; identical to SEQ ID NO: 820099

SEQ ID NO: 820119 - protein, 223 aa, Homo sapiens; identical to SEQ ID NO: 820099

SEQ ID NO: 820120 - protein, 223 aa, Homo sapiens; identical to SEQ ID NO: 820099

SEQ ID NO: 820121 - protein, 224 aa, Homo sapiens
TFSFLLFLSVLPHSRALLTPNRAPKKKMAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCLDKRRPSSI

SEQ ID NO: 820122 - protein, 115 aa, Homo sapiens; identical to SEQ ID NO: 820108

SEQ ID NO: 820123 - protein, 88 aa, Homo sapiens
MRRPRSTTGRKDRPTRPASTDTTRRPHNQDRTKAASVNSEREHTEEKDENGTRGQRRKSTLTQKRTPRAHTRTNHTYTTHNATQPTHP

SEQ ID NO: 820124 - protein, 1460 aa, Homo sapiens [sequence omitted]

SEQ ID NO: 820125 - protein, 1584 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCSIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREELVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 820126 - protein, 1486 aa, Homo sapiens [sequence omitted]

SEQ ID NO: 820127 - protein, 1622 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCSIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVTASSFYKLLYQTEPPQKQRLSYRFCNPLQWLAKSLWRVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREELVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 820128 - protein, 1622 aa, Homo sapiens; identical to SEQ ID NO: 820127

SEQ ID NO: 820129 - protein, 1622 aa, Homo sapiens; identical to SEQ ID NO: 820127

SEQ ID NO: 820130 - protein, 1181 aa, Homo sapiens
TKLEKAKSPTADAKVVSLSLQTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREELVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 820131 - protein, 1632 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCSIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVTASSFYKLLYQTEPPQKQRLSYRFCNPLQWLAKSLWRVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREEVGDLHGEMHKLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 820132 - protein, 1538 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCSIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVTASSFYKLLYQTEPPQKQRLSYRFCNPLQWLAKSLWRVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREEVGDLHGEMHKLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQEC

SEQ ID NO: 820133 - protein, 1581 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCSIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVTASSFYKLLYQTEPPQKQRLSYRFCNPLQWLAKSLWRVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREEVGDLHGEMHKLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPAML

SEQ ID NO: 820134 - protein, 1614 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCSIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVTASSFYKLLYQTEPPQKQRLSYRFCNPLQWLAKSLWRVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREEVGDLHGEMHKLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPDSTPMGKRKMLQYKNDFLLIVEKSLPVEWLGILEAA

SEQ ID NO: 820135 - protein, 310 aa, Homo sapiens [sequence omitted]

SEQ ID NO: 820136 - protein, 1665 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCSIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVTASSFYKLLYQTEPPQKQRLSYRFCNPLQWLAKSLWRVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREEVGDLHGEMHKLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEEKKKKKKNKKKKKQKKKKKNTERKKNRTKTTTTRTNDRK

SEQ ID NO: 820137 - protein, 1492 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCSIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVTASSFYKLLYQTEPPQKQRLSYRFCNPLQWLAKSLWRVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREEVGDLHGEMHKLVDRVFDESLNFRKIPPLVHSKTPEGNNGRSGDPRPQAAEPPDHLTITRRRTWSRDEVMGDNLLLSSVFQFSKKIRQSIDKTAGKIRYMYI

SEQ ID NO: 820138 - protein, 1186 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCSIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVTASSFYKLLYQTEPPQKQRLSYRFCNPLQWLAKSLWRVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSGGKNHEAGHQGAA

SEQ ID NO: 820139 - protein, 535 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCSIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVTASSFYKLLYQT

SEQ ID NO: 820140 - protein, 644 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCSIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVFGVDDNQDYNRPVINEKHKDLIKDWALSSAAAVMEERKPLTTSGFHHSEEGTSSSGSKRWVSQWASLAANHTRHDQEERIMEFSAPLPLENGILFLSFILYPFFLLFLHFSLFLLLFSAFL

SEQ ID NO: 820141 - protein, 498 aa, Homo sapiens
RPPAPARLIPHIPASPLPTTPLPRPPLRLPRARRSGPAGAPPRARTRLSRPVGSGPEPRATSTIASNSWNASSSPGEAREDGPEGLDKGLDNDAEGVWSPDIEQSFQEALAIYPPCGRRKIILSDEGKMYGRNELIARYIKLRTGKTRTRKQVSSHIQVLARKKVREYQVGIKAMNLDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWADLNSTIQEGPGAFYGVSSQYSSADSMTISVSTKVCSFGKQVVEKVETEYARLENGRFVYRIHRSPMCEYMINFIHKLKHLPEKYMMNSVLENFTILQVVTSRDSQETLLVIAFVFEVSTSEHGAQHHVYKLVKD

SEQ ID NO: 820142 - protein, 459 aa, Homo sapiens
RPPAPARLIPHIPASPLPTTPLPRPPLRLPRARRSGPAGAPPRARTRLSRPVGSGPEPRATSTIASNSWNASSSPGEAREDGPEGLDKGLDNDAEGVWSPDIEQSFQEALAIYPPCGRRKIILSDEGKMYGRNELIARYIKLRTGKTRTRKQVSSHIQVLARKKVREYQVGIKAMNLDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWADLNSTIQEGPGAFYGVSSQYSSADSMTISVSTKVCSFGKQVVEKVETEYARLENGRFVYRIHRSPMCEYMINFIHKLKLFQTGHEEGSTAATRPH

SEQ ID NO: 820143 - protein, 214 aa, Homo sapiens
MCLGRRLGVYSLHGGAARPDTYSKHLFVHIGQTNPAFSDPPLEAVDVRQIYDKFPEKKGGLKELYEKGPPNAFFLVKFWADLNSTIQEGPGAFYGVSSQYSSADSMTISVSTKVCSFGKQVVEKVETEYARLENGRFVYRIHRSPMCEYMINFIHKLKHLPEKYMMNSVLENFTILQVVTSRDSQETLLVIAFVFEVSTSEHGAQHHVYKLVKD

SEQ ID NO: 820144 - protein, 164 aa, Homo sapiens
PLQTLQWVDGSRWNFAYWAAHQPWSRGGHCVALLYRVGVLQNKFSPPSPLPQAVFSTSSRFWSSPPLLGQQPGPSQDIKPFAQPAYPIQPPLPPTLSSKFPTRGALPWHLHLHSGELGSNCVCLLWEGGGCDIYRRLDRPGIAPLPCTMLLPDLWHKTIAKPGV

SEQ ID NO: 820145 - protein, 337 aa, Homo sapiens
MSSNLSSFSPSQAMNLDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWADLNSTIQEGPGAFYGVSSQYSSADSMTISVSTKVCSFGKQVVEKVETEYARLENGRFVYRIHRSPMCEYMINFIHKLKHLPEKYMMNSVLENFTILQVVTSRDSQETLLVIAFVFEVSTSEHGAQHHVYKLVKD

SEQ ID NO: 820146 - protein, 324 aa, Homo sapiens
MNLDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWADLNSTIQEGPGAFYGVSSQYSSADSMTISVSTKVCSFGKQVVEKVETEYARLENGRFVYRIHRSPMCEYMINFIHKLKHLPEKYMMNSVLENFTILQVVTSRDSQETLLVIAFVFEVSTSEHGAQHHVYKLVKD

SEQ ID NO: 820147 - protein, 289 aa, Homo sapiens
MDAEGPLGLVSSLQFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWADLNSTIQEGPGAFYGVSSQYSSADSMTISVSTKVCSFGKQVVEKVETEYARLENGRFVYRIHRSPMCEYMINFIHKLKHLPEKYMMNSVLENFTILQVVTSRDSQETLLVIAFVFEVSTSEHGAQHHVYKLVKD

SEQ ID NO: 820148 - protein, 525 aa, Homo sapiens
RPPAPARLIPHIPASPLPTTPLPRPPLRLPRARRSGPAGAPPRARTRLSRPVGSGPEPRATSTIASNSWNASSSPGEAREDGPEGLDKGLDNDAEGVWSPDIEQSFQEALAIYPPCGRRKIILSDEGKMYGRNELIARYIKLRTGKTRTRKQVSSHIQVLARKKVREYQVGIKAMNLDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWATIYRATILGRSPGEPFIIVGHSIFDVTRHHDVELATDLIHASSRPKVVASRLAKAGLVMMIRLRDLSTALGVVGNGLHWMLRVVTARPRSYCVDDTVSHRFIPGRHLPEKYMMNSVLENFTILQVVTSRDSQETLLVIAFVFEVSTSEHGAQHHVYKLVKD

SEQ ID NO: 820149 - protein, 214 aa, Homo sapiens; identical to SEQ ID NO: 820143

SEQ ID NO: 820150 - protein, 498 aa, Homo sapiens; identical to SEQ ID NO: 820141

SEQ ID NO: 820151 - protein, 498 aa, Homo sapiens
RPPAPARLIPHIPASPLPTTPLPRPPLRLPRARRSGPAGAPPRARTRLSRPVGSGPEPRATSTIASNSWNASSSPGEAREDGPEGLDKGLDNDAEGVWSPDIEQSFQEALAIYPPCGRRKIILSDEGKMYGRNELIARYIKLRTGKTRTRKQVSSHIQVLARKKVREYQVGIKAMNLDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWADLNSTIQEGPGAFYGVSSQYSSADSMTISVSTKVCSFGKQVVEKVETEYARLENGRFVYRIHRSPMCEYMINFIHKLKHLPEKYMMNSVLENFTILQVVTSRDSQETLLVIAFVFEVSTSEHGAQHHVYKLVKE

SEQ ID NO: 820152 - protein, 447 aa, Homo sapiens
RPPAPARLIPHIPASPLPTTPLPRPPLRLPRARRSGPAGAPPRARTRLSRPVGSGPEPRATSTIASNSWNASSSPGEAREDGPEGLDKGLDNDAEGVWSPDIEQSFQEALAIYPPCGRRKIILSDEGKMYGRNELIARYIKLRTGKTRTRKQVSSHIQVLARKKVREYQVGIKAMNLDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWADLNSTIQEGPGAFYGVSSQYSSADSMTISVSTKVCSFGKQVVEKVETEYARLENGRFVYRIHRSPMCEYMINFIHKLKPARAS

SEQ ID NO: 820153 - protein, 130 aa, Homo sapiens
MSSNLSSFSPSQAMNLDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIARPPPNPT

SEQ ID NO: 820154 - protein, 167 aa, Homo sapiens
MSSNLSSFSPSQAMNLDQVSKDKALQSMASMSSAQIVSASVLQNKFSPPSPLPQAVFSTSSRFWSSPPLLGQQPGPSQDIKPFAQPAYPIQPPLPPTLSSKFPTRGALPWHLHLHSGELGSNCVCLLWEGGGCDIYRRLGQARNSPFTLYNVASRSLAQNHSQARRG

SEQ ID NO: 820155 - protein, 321 aa, Homo sapiens
RPPAPARLIPHIPASPLPTTPLPRPPLRLPRARRSGPAGAPPRARTRLSRPVGSGPEPRATSTIASNSWNASSSPGEAREDGPEGLDKGLDNDAEGVWSPDIEQSFQEALAIYPPCGRRKIILSDEGKMYGRNELIARYIKLRTGKTRTRKQVSSHIQVLARKKVREYQVGIKAMNLDQVSKDKALQSMASMSSAQIVSASVLQNKFSPPSPLPQAVFSTSSRFWSSPPLLGQQPGPSQDIKPFAQKDDEYLDKVERNIKKSLQEHLPDVVVYNAGTDILEGDRLGGLSISPAGIVKRDELVFQDGPCHRVPILMVHSGGI

SEQ ID NO: 820156 - protein, 80 aa, Homo sapiens
LVPVPVCLSPRLSRPVGSGPEPRATSTIASNSWNASSSPGEAREDGPEGLDKGLDNDAEGVWSPDIEQSFQEALAIYPPC

SEQ ID NO: 820157 - protein, 712 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPSPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHLEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 820158 - protein, 712 aa, Homo sapiens; identical to SEQ ID NO: 820157

SEQ ID NO: 820159 - protein, 686 aa, Homo sapiens [sequence omitted]

SEQ ID NO: 820160 - protein, 482 aa, Homo sapiens
MRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHLEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 820161 - protein, 682 aa, Homo sapiens [sequence omitted]

SEQ ID NO: 820162 - protein, 699 aa, Homo sapiens [sequence omitted]

SEQ ID NO: 820163 - protein, 633 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPSPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLVYERLEKLQAVVAGVPGHLEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 820164 - protein, 699 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPSPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHLEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 820165 - protein, 824 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPSPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVSPDPSAGSEEEKPQAGRGGGCRVHCGPGAICQDPRRLQLQGPPPSEALLLTLHLTVCLNLSSSGLSELPELQSHNIWLCLCPHPCQAQSMSTPEASSLPGHCHALPLPSLQVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHLEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 820166 - protein, 242 aa, Homo sapiens
MQIYKKHLDPRPGPCPPELGLGLGQLACCCLHRRAKRRPPMTQVYERLEKLQAVVAGVPGHLEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 820167 - protein, 662 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPSPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHLEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLGLEQDRQGPEESDEFQS

SEQ ID NO: 820168 - protein, 271 aa, Homo sapiens
MVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 820169 - protein, 215 aa, Homo sapiens
MVYRIDMSTTPRSYDQVYERLEKLQAVVAGVPGHLEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 820170 - protein, 712 aa, Homo sapiens; identical to SEQ ID NO: 820157

SEQ ID NO: 820171 - protein, 667 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPSPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHLEAASCIPPSPQENSYVSSTGRAHSGAAPWQPLAAPSGASAQAAEQLQRGPNQPVESDESLGGLSAALRSWHLTPSCPLDPAPCTMGPTRPRALLPAYNLEKCGRVRWLTPVIPALWEAKAGGSLEPSRSRPARAT

SEQ ID NO: 820172 - protein, 712 aa, Homo sapiens; identical to SEQ ID NO: 820157

SEQ ID NO: 820173 - protein, 712 aa, Homo sapiens; identical to SEQ ID NO: 820157

SEQ ID NO: 820174 - protein, 182 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPG

SEQ ID NO: 820175 - protein, 712 aa, Homo sapiens; identical to SEQ ID NO: 820157

SEQ ID NO: 820176 - protein, 440 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPSPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLLARPKT

SEQ ID NO: 820177 - protein, 415 aa, Homo sapiens [sequence omitted]

SEQ ID NO: 820178 - protein, 326 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPSPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGKSGFM

SEQ ID NO: 820179 - protein, 345 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPSPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGSTGFTVILCSAVSHTTCPREAGHW

SEQ ID NO: 820180 - protein, 203 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITACERGTPGTPRLGGRRAPRGSPTRASTFLSFLGSRLALGSSASSSSEPPQIIINPARQKMVQKLALYEDGALDSLQLLSSSSLPGLGLEQDRQGPEESDEFQS

SEQ ID NO: 820181 - protein, 136 aa, Homo sapiens
EGWLGSRNGHPATSPVPLCHPRPRPAHLSPGLSDWTSFWVQPGQFSFYIRTAPASSMETSRGEEGPLRTAGAGPAARGAPRPINVGIRHGLGPQHPGIAQVWERAKEGPTDEQRPPGSWSAQGSASAFCGQGTGLA

SEQ ID NO: 820182 - protein, 41 aa, Homo sapiens
MNFRADVFTWADPPNPEVKVLMVRSSHGARVLSTLPAVGVG

SEQ ID NO: 820183 - protein, 127 aa, Homo sapiens
MKHYGLPWKRTEEAAAGNECFKTTVLSCLGNTFAFLRFSLATMVTLHTAFLNSRAGWSRTPDLMWSSCLGLPRCWDYRHEPLHLARFFIFVKSVLYFNIFKIRLLFRSISICSQGSGSRLSFTHIRW

SEQ ID NO: 820184 - protein, 117 aa, Homo sapiens
MLSRRQLKSESKSKTVLIGVELLLSHPRSLPLSYPDLCSFKERNVHSAPVNPTAGVLCTALHSLKRAWATERDSISKKKKKKIGDYVYRFTTLKPSSSLRTDASNEGKDCMFLMKLP

SEQ ID NO: 820185 - protein, 148 aa, Homo sapiens
MTGWSCLVTGAGGFLGQRIIRLLVKEKELKEIRVLDKAFGPELREEFSKLQNKTKLTVLEGDILDEPFLKRACQDVSVIIHTACIIDVFGVTHRESIMNVNVKGMVGWGGDAARWGIKDHKEGQEGKRSPSTEHLLCSGPSAFADHYE

SEQ ID NO: 820186 - protein, 113 aa, Homo sapiens
YVTSPLSENFSARYRNHSNDLTSAHTELQNKIKLTVLEGDILDEPFLKRACQDVSVVIHTACIIDVFGVTHRQSIMNVNVKAPVGGLCPSYCASLHLHQYPPVSRAQLLQGNH

SEQ ID NO: 820187 - protein, 373 aa, Homo sapiens [sequence omitted]

SEQ ID NO: 820188 - protein, 373 aa, Homo sapiens [sequence omitted]

SEQ ID NO: 820189 - protein, 373 aa, Homo sapiens [sequence omitted]

SEQ ID NO: 820190 - protein, 186 aa, Homo sapiens
MYIYGEGSRFLSASINEALNNNGILSSVGKFSTVNPVYVGNVAWAHILALRALQDPKKAPSIRGQFYYISDDTPHQSYDNLNYTLSKEFGLRLDSRWSFPLSLMYWIGFLLEIVSFLLRPIYTYRPPFNRHIVTLSNSVFTFSYKKAQRDLAYKPLYSWEEAKQKTVEWVGSLVDRHKENLKSKTQ

SEQ ID NO: 820191 - protein, 346 aa, Homo sapiens
RSKTKRGEVCKARTELSEEFLKLQNKTKLTVLEGDILDEPFLKRACQDVSVIIHTACIIDVFGVTHRESIMNVNVKGTQLLLEACVQASVPVFIYTSSIEVAGPNSYKEIIQNGHEEEPLENTWPAPYPHSKKLAEKAVLAANGWNLKNGGTLYTCALRPMYIYGEGSRFLSASINEALNNNGILSSVGKFSTVNPVYVGNVAWAHILALRALQDPKKAPSIRGQFYYISDDTPHQSYDNLNYTLSKEFGLRLDSRWSFPLSLMYWIGFLLEIVSFLLRPIYTYRPPFNRHIVTLSNSVFTFSYKKAQRDLAYKPLYSWEEAKQKTVEWVGSLVDRHKENLKSKTQ

SEQ ID NO: 820192 - protein, 118 aa, Homo sapiens [sequence omitted]

SEQ ID NO: 820193 - protein, 288 aa, Homo sapiens
MTGWSCLVTGAGGFLGQRIIRLLVKEKELKEIRVLDKAFGPELREEFSKLQNKTKLTVLEGDILDEPFLKRACQDVSVIIHTACIIDVFGVTHRESIMNVNVKGTQLLLEACVQASVPVFIYTSSIEVAGPNSYKEIIQNGHEEEPLENTWPAPYPHSKKLAEKAVLAANGWNLKNGGTLYTCALRPMYIYGEGSRFLSASINEALNNNGILSSVGVSLLSVCACAGTLLRLQTPAREVSFSMHAHKYVLYTGRVARCSVSFFLCLLCVYGFICIHIDASRTSCHTFT

SEQ ID NO: 820194 - protein, 118 aa, Homo sapiens [sequence omitted]

SEQ ID NO: 820195 - protein, 128 aa, Homo sapiens
TIELGPVLHEMCMWVLLGDVIKLHPPGLIQKVTRAQAQVLLPPFHTMANLLYSSCHQNLRSHWPNKKVSVLIIYQRKDHVVCCYQISVADSEQFRDSFNLRVVLTTRAPFLLLNEKGFPFFLIFHSFT

SEQ ID NO: 820196 - protein, 175 aa, Homo sapiens
MTGWSCLVTGAGGFLGQRIIRLLVKEKELKEIRVLDKAFGPELREEFSKLQNKTKLTVLEGDILDEPFLKRACQDVSVIIHTACIIDVFGVTHRESIMNVNVKGTQLLLEACVQASVPVFIYTSSIEVAGPNSYKEIIQNGHEEEPLENTWPAHPYWPAFTPVSDTVCPHIRTGP

SEQ ID NO: 820197 - protein, 127 aa, Homo sapiens
VTAHQNNKNRHARPERRQTKNHNNNAGNTQRPRWISEVNRAEETNAPTAAGRARHQNLRSHWPNKKVSVLIIYQRKDHVVCCYQISVADSEQFRDSFNLRVVLTTRAPFLLLNEKGFPFFLIFHSFT

SEQ ID NO: 820198 - protein, 429 aa, Homo sapiens
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 820199 - protein, 211 aa, Homo sapiens
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGNVSFQRFSHKGKNFEAMVAEPKNQSSEF

SEQ ID NO: 820200 - protein, 270 aa, Homo sapiens
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMVKT

SEQ ID NO: 820201 - protein, 222 aa, Homo sapiens
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGESRLSIGHRERSIFIPAFPQYTHHLCTTSSEQSQQSGRL

SEQ ID NO: 820202 - protein, 211 aa, Homo sapiens; identical to SEQ ID NO: 820199

SEQ ID NO: 820203 - protein, 163 aa, Homo sapiens
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWL

SEQ ID NO: 820204 - protein, 213 aa, Homo sapiens
MFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISK

SEQ ID NO: 820205 - protein, 2975 aa, Homo sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIKRCKETSEHGAYSDLLQRQKATVLENSKLTGKISELERMVAELKKQKSRVEEELPKVREAAENELRKQQRNVEDISLQKIRAESEAKQYRRELETIVREKEAAERELERVRQLTIEAEAKRAAVEENLLNFRNQLEENTFTRRTLEDHLKRKDLSLNDLEQQKNKLMEELRRKRDNEEELLKLIKQMEKDLAFQKQVAEKQLKEKQKIELEARRKITEIQYTCRENALPVCPITQATSCRAVTGLQQEHDKQKAEELKQQVDELTAANRKAEQDMRELTYELNALQLEKTSSEEKARLLKDKLDETNNTLRCLKLELERKDQAEKGYSQQLRELGRQLNQTTGKAEEAMQEASDLKKIKRNYQLELESLNHEKGKLQREVDRITRAHAVAEKNIQHLNSQIHSFRDEKELERLQICQRKSDHLKEQFEKSHEQLLQNIKAEKENNDKIQRLNEELEKSNECAEMLKQKVEELTRQNNETKLMMQRIQAESENIVLEKQTIQQRCEALKIQADGFKDQLRSTNEHLHKQTKTEQDFQRKIKCLEEDLAKSQNLVSEFKQKCDQQNIIIQNTKKEVRNLNAELNASKEEKRRGEQKVQLQQAQVQELNNRLKKVQDELHLKTIEEQMTHRKMVLFQEESGKFKQSAEEFRKKMEKLMESKVITENDISGIRLDFVSLQQENSRAQENAKLCETNIKELERQLQQYREQMQQGQHMEANHYQKCQKLEDELIAQKREVENLKQKMDQQIKEHEHQLVLLQCEIQKKSTAKDCTFKPDFEMTVKECQHSGELSSRNTGHLHPTPRSPLLRWTQEPQPLEEKWQHRVVEQIPKEVQFQPPGAPLEKEKSQQCYSEYFSQTSTELQITFDETNPITRLSEIEKIRDQALNNSRPPVRYQDNACEMELVKVLTPLEIAKNKQYDMHTEVTTLKQEKNPVPSAEEWMLEGCRASGGLKKGDFLKKGLEPETFQNFDGDHACSVRDDEFKFQGLRHTVTARQLVEAKLLDMRTIEQLRLGLKTVEEVQKTLNKFLTKATSIAGLYLESTKEKISFASAAERIIIDKMVALAFLEAQAATGFIIDPISGQTYSVEDAVLKGVVDPEFRIRLLEAEKAAVGYSYSSKTLSVFQAMENRMLDRQKGKHILEAQIASGGVIDPVRGIRVPPEIALQQGLLNNAILQFLHEPSSNTRVFPNPNNKQALYYSELLRMCVFDVESQCFLFPFGERNISNLNVKKTHRISVVDTKTGSELTVYEAFQRNLIEKSIYLELSGQQYQWKEAMFFESYGHSSHMLTDTKTGLHFNINEAIEQGTIDKALVKKYQEGLITLTELADSLLSRLVPKKDLHSPVAGYWLTASGERISVLKASRRNLVDRITALRCLEAQVSTGGIIDPLTGKKYRVAEALHRGLVDEGFAQQLRQCELVITGIGHPITNKMMSVVEAVNANIINKEMGIRCLEFQYLTGGLIEPQVHSRLSIEEALQVGIIDVLIATKLKDQKSYVRNIICPQTKRKLTYKEALEKADFDFHTGLKLLEVSEPLMTGISSLYYSS

SEQ ID NO: 820206 - protein, 3091 aa, Homo sapiens
MGNVCGCVRAEKEEQYVDPAKTPLNPEKYSPGRKYFRRKPIKKTGGDKESVGANNENEGKKKSSSQPSKEQPAPLSRGLVQQESVTLNSALGDGIQQKKTEVVADSVKQKLLPSAVSSWSDCVNTSPAKDSETEVKVSELDERISEKDSTPYCAKRKKHLDDVNTSEITFQEKTDVFSFRKAASLSSIPSGIERSLEKSGFPEDPPKSYSSIQEKQNTERFCPHATQHFQFKKKRCHSLYTSMSSVSKDTDGNEISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIKRCKETSEHGAYSDLLQRQKATVLENSKLTGKISELERMVAELKKQKSRVEEELPKVREAAENELRKQQRNVEDISLQKIRAESEAKQYRRELETIVREKEAAERELERVRQLTIEAEAKRAAVEENLLNFRNQLEENTFTRRTLEDHLKRKDLSLNDLEQQKNKLMEELRRKRDNEEELLKLIKQMEKDLAFQKQVAEKQLKEKQKIELEARRKITEIQYTCRENALPVCPITQATSCRAVTGLQQEHDKQKAEELKQQVDELTAANRKAEQDMRELTYELNALQLEKTSSEEKARLLKDKLDETNNTLRCLKLELERKDQAEKGYSQQLRELGRQLNQTTGKAEEAMQEASDLKKIKRNYQLELESLNHEKGKLQREVDRITRAHAVAEKNIQHLNSQIHSFRDEKELERLQICQRKSDHLKEQFEKSHEQLLQNIKAEKENNDKIQRLNEELEKSNECAEMLKQKVEELTRQNNETKLMMQRIQAESENIVLEKQTIQQRCEALKIQADGFKDQLRSTNEHLHKQTKTEQDFQRKIKCLEEDLAKSQNLVSEFKQKCDQQNIIIQNTKKEVRNLNAELNASKEEKRRGEQKVQLQQAQVQELNNRLKKVQDELHLKTIEEQMTHRKMVLFQEESGKFKQSAEEFRKKMEKLMESKVITENDISGIRLDFVSLQQENSRAQENAKLCETNIKELERQLQQYREQMQQGQHMEANHYQKCQKLEDELIAQKREVENLKQKMDQQIKEHEHQLVLLQCEIQKKSTAKDCTFKPDFEMTVKECQHSGELSSRNTGHLHPTPRSPLLRWTQEPQPLEEKWQHRVVEQIPKEVQFQPPGAPLEKEKSQQCYSEYFSQTSTELQITFDETNPITRLSEIEKIRDQALNNSRPPVRYQDNACEMELVKVLTPLEIAKNKQYDMHTEVTTLKQEKNPVPSAEEWMLEGCRASGGLKKGDFLKKGLEPETFQNFDGDHACSVRDDEFKFQGLRHTVTARQLVEAKLLDMRTIEQLRLGLKTVEEVQKTLNKFLTKATSIAGLYLESTKEKISFASAAERIIIDKMVALAFLEAQAATGFIIDPISGQTYSVEDAVLKGVVDPEFRIRLLEAEKAAVGYSYSSKTLSVFQAMENRMLDRQKGKHILEAQIASGGVIDPVRGIRVPPEIALQQGLLNNAILQFLHEPSSNTRVFPNPNNKQALYYSELLRMCVFDVESQCFLFPFGERNISNLNVKKTHRISVVDTKTGSELTVYEAFQRNLIEKSIYLELSGQQYQWKEAMFFESYGHSSHMLTDTKTGLHFNINEAIEQGTIDKALVKKYQEGLITLTELADSLLSRLVPKKDLHSPVAGYWLTASGERISVLKASRRNLVDRITALRCLEAQVSTGGIIDPLTGKKYRVAEALHRGLVDEGFAQQLRQCELVITGIGHPITNKMMSVVEAVNANIINKEMGIRCLEFQYLTGGLIEPQVHSRLSIEEALQVGIIDVLIATKLKDQKSYVRNIICPQTKRKLTYKEALEKADFDFHTGLKLLEVSEPLMTGISSLYYSS

SEQ ID NO: 820207 - protein, 2221 aa, Homo sapiens
SHWTIYYNIYRIKKITPGRLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIKRCKETSEHGAYSDLLQRQKATVLENSKLTGKISELERMVAELKKQKSRVEEELPKVREAAENELRKQQRNVEDISLQKIRAESEAKQYRRELETIVREKEAAERELERVRQLTIEAEAKRAAVEENLLNFRNQLEENTFTRRTLEDHLKRKDLSLNDLEQQKNKLMEELRRKRDNEEELLKLIKQMEKDLAFQKQVAEKQLKEKQKIELEARRKITEIQYTCRENALPVCPITQATSCRAVTGLQQEHDKQKAEELKQQVDELTAANRKAEQDMRELTYELNALQLEKTSSEEKARLLKDKLDETNNTLRCLKLELERKDQAEKGYSQQLRELGRQLNQTTGKAEEAMQEASDLKKIKRNYQLELESLNHEKGKLQREVDRITRAHAVAEKNIQHLNSQIHSFRDEKELERLQICQRKSDHLKEQFEKSHEQLLQNIKAEKENNDKIQRLNEELEKSNECAEMLKQKVEELTRQNNETKLMMQRIQAESENIVLEKQTIQQRCEALKIQADGFKDQLRSTNEHLHKQTKTEQDFQRKIKCLEEDLAKSQNLVSEFKQKCDQQNIIIQNTKKEVRNLNAELNASKEEKRRGEQKVQLQQAQVQELNNRLKKVQDELHLKTIEEQMTHRKMVLFQEESGKFKQSAEEFRKKMEKLMESKVITENDISGIRLDFVSLQQENSRAQENAKLCETNIKELERQLQQYREQMQQGQHMEANHYQKCQKLEDELIAQKREVENLKQKMDQQIKEHEHQLVLLQCEIQKKSTAKDCTFKPDFEMTVKECQHSGELSSRNTGHLHPTPRSPLLRWTQEPQPLEEKWQHRVVEQIPKEVQFQPPGAPLEKEKSQQCYSEYFSQTSTELQITFDETNPITRLSEIEKIRDQALNNSRPPVRYQDNACEMELVKVLTPLEIAKNKQYDMHTEVTTLKQEKNPVPSAEEWMLEGCRASGGLKKGDFLKKGLEPETFQNFDGDHACSVRDDEFKFQGLRHTVTARQLVEAKLLDMRTIEQLRLGLKTVEEVQKTLNKFLTKATSIAGLYLESTKEKISFASAAERIIIDKMVALAFLEAQAATGFIIDPISGQTYSVEDAVLKGVVDPEFRIRLLEAEKAAVGYSYSSKTLSVFQAMENRMLDRQKGKHILEAQIASGGVIDPVRGIRVPPEIALQQGLLNNAILQFLHEPSSNTRVFPNPNNKQALYYSELLRMCVFDVESQCFLFPFGERNISNLNVKKTHRISVVDTKTGSELTVYEAFQRNLIEKSIYLELSGQQYQWKEAMFFESYGHSSHMLTDTKTGLHFNINEAIEQGTIDKALVKKYQEGLITLTELADSLLSRLVPKKDLHSPVAGYWLTASGERISVLKASRRNLVDRITALRCLEAQVSTGGIIDPLTGKKYRVAEALHRGLVDEGFAQQLRQCELVITGIGHPITNKMMSVVEAVNANIINKEMGIRCLEFQYLTGGLIEPQVHSRLSIEEALQVGIIDVLIATKLKDQKSYVRNIICPQTKRKLTYKEALEKADFDFHTGLKLLEVSEPLMTGISSLYYSS

SEQ ID NO: 820208 - protein, 2347 aa, Homo sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIKRCKETSEHGAYSDLLQRQKATVLENSKLTGKISELERMVAELKKQKSRVEEELPKVREAAENELRKQQRNVEDISLQKIRAESEAKQYRRELETIVREKEAAERELERVRQLTIEAEAKRAAVEENLLNFRNQLEENTFTRRTLEDHLKRKDLSLNDLEQQKNKLMEELRRKRDNEEELLKLIKQMEKDLAFQKQVAEKQLKEKQKIELEARRKITEIQYTCRENALPVCPITQATSCRAVTGLQQEHDKQKAEELKQQVDELTAANRKAEQDMRELTYELNALQLEKTSSEEKARLLKDKLDETNNTLRCLKLELERKDQAEKGYSQQLRELGRQLNQTTGKAEEAMQEASDLKKIKRNYQLELESLNHEKGKLQREVDRITRAHAVAEKNIQHLNSQIHSFRDEKELERLQICQRKSDHLKEQFEKSHEQLLQNIKAEKENNDKIQRLNEELEKSNECAEMLKQKVEELTRQNNETKLMMQRIQAESENIVLEKQTIQQRCEALKIQADGFKDQLRSTNEHLHKQTKTEQDFQRKIKCLEEDLAKSQNLVSEFKQKCDQQNIIIQNTKKEVRNLNAELNASKEEKRRGEQKVQLQQAQVQELNNRLKKVQDELHLKTIEEQMTHRKMVLFQEESGKFKQSAEEFRKKMEKLMESKVITENDISGIRLDFVSLQQENSRAQENAKLCETNIKELERQLQQYREQMQQGQHMEANHYQKCQKLEDELIAQKREVENLKQKMDQQIKEHEHQLVLLQCEIQKKSTAKDCTFKPDFEMTVKECQHSGELSSRNTGHLHPTPRSPLLRWTQEPQPLEEKWQHRVVEQIPKEVQFQPPGAPLEKEKSQQCYSEYFSQTSTELQITFDETNPITRLSEIEKIRDQALNNSRPPVRYQDNACEMELVKVLTPLEVYSVF

SEQ ID NO: 820209 - protein, 789 aa, Homo sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEVKLESVMVLVEY

SEQ ID NO: 820210 - protein, 373 aa, Homo sapiens
WCSRGSRKAHCNTRVFPNPNNKQALYYSELLRMCVFDVESQCFLFPFGERNISNLNVKKTHRISVVDTKTGSELTVYEAFQRNLIEKSIYLELSGQQYQWKEAMFFESYGHSSHMLTDTKTGLHFNINEAIEQGTIDKALVKKYQEGLITLTELADSLLSRLVPKKDLHSPVAGYWLTASGERISVLKASRRNLVDRITALRCLEAQVSTGGIIDPLTGKKYRVAEALHRGLVDEGFAQQLRQCELVITGIGHPITNKMMSVVEAVNANIINKEMGIRCLEFQYLTGGLIEPQVHSRLSIEEALQVGIIDVLIATKLKDQKSYVRNIICPQTKRKLTYKEALEKADFDFHTGLKLLEVSEPLMTGISSLYYSS

SEQ ID NO: 820211 - protein, 2649 aa, Homo sapiens
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIKRCKETSEHGAYSDLLQRQKATVLENSKLTGKISELERMVAELKKQKSRVEEELPKVREAAENELRKQQRNVEDISLQKIRAESEAKQYRRELETIVREKEAAERELERVRQLTIEAEAKRAAVEENLLNFRNQLEENTFTRRTLEDHLKRKDLSLNDLEQQKNKLMEELRRKRDNEEELLKLIKQMEKDLAFQKQVAEKQLKEKQKIELEARRKITEIQYTCRENALPVCPITQATSCRAVTGLQQEHDKQKAEELKQQVDELTAANRKAEQDMRELTYELNALQLEKTSSEEKARLLKDKLDETNNTLRCLKLELERKDQAEKGYSQQLRELGRQLNQTTGKAEEAMQEASDLKKIKRNYQLELESLNHEKGKLQREVDRITRAHAVAEKNIQHLNSQIHSFRDEKELERLQICQRKSDHLKEQFEKSHEQLLQNIKAEKENNDKIQRLNEELEKSNECAEMLKQKVEELTRQNNETKLMMQRIQAESENIVLEKQTIQQRCEALKIQADGFKDQLRSTNEHLHKQTKTEQDFQRKIKCLEEDLAKSQNLVSEFKQKCDQQNIIIQNTKKEVRNLNAELNASKEEKRRGEQKVQLQQAQVQELNNRLKKVQDELHLKTIEEQMTHRKMVLFQEESGKFKQSAEEFRKKMEKLMESKVITENDISGIRLDFVSLQQENSRAQENAKLCETNIKELERQLQQYREQMQQGQHMEANHYQKCQKLEDELIAQKREVENLKQKMDQQIKEHEHQLVLLQCEIQKKSTAKDCTFKPDFEMTVKECQHSGELSSRNTGHLHPTPRSPLLRWTQEPQPLEEKWQHRVVEQIPKEVQFQPPGAPLEKEKSQQCYSEYFSQTSTELQITFDETNPITRLSEIEKIRDQALNNSRPPVRYQDNACEMELVKVLTPLEIAKNKQYDMHTEVTTLKQEKNPVPSAEEWMLEGCRASGGLKKGDFLKKGLEPETFQNFDGDHACSVRDDEFKFQGLRHTVTARQLVEAKLLDMRTIEQLRLGLKTVEEVQKTLNKFLTKATSIAGLYLESTKEKISFASAAERIIIDKMVALAFLEAQAATGFIIDPISGQTYSVEDAVLKGVVDPEFRIRLLEAEKAAVGYSYSSKTLSVFQAMENRMLDRQKGKHILEAQIASGGVIDPVRGIRVPPEIALQQGLLNNAILQFLHEPSSNTRVFPNPNNKQALYYSELLRMCVFDVESQCFLFPFGERNISNLNVKKTHRISVVDTKTGSELTVYEAFQRNLIEKSIYLELSGQQYQWKEAMFFESYGHSSHMLTDTKTGLHFNINEAIEQGTIDKALVKKYQEGLITLTELADSLLSRLVPKKDLHSPVAGYWLTASGERISVLKASRRNLVDRITALRCLEAQVSTGGIIDPLTGKKYRVAEALHRGLVDEGFAQQLRQCELVITGIGHPITNKMMSVVEAVNANIINKEMGIRCLEFQYLTGGLIEPQVHSRLSIEEALQVGIIDVLIATKLKDQKSYVRNIICPQTKRKLTYKEALEKADFDFHTGLKLLEVSEPLMTGISSLYYSS

SEQ ID NO: 820212 - protein, 265 aa, Homo sapiens [sequence omitted]

SEQ ID NO: 820213 - protein, 3153 aa, Homo sapiens
MIAAAFLVLLRPYSIQCALFLLLLLLGTIATIVFFCCWHRKLQKGRHPMKSVFSGRSRSRDAVLRSHHFRSEGFRASPRHLRRRVAAAAAARLEEVKPVVEVHHQSEQETSVRKRRIKKSSRVQPEFYHSVQGASIRRPSSGNASYRCSMSSSADFSDEDDFSQKSGSASPAPGDTLPWNLPKHERSKRKIQGGSVLDPAERAVLRIADERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIKRCKETSEHGAYSDLLQRQKATVLENSKLTGKISELERMVAELKKQKSRVEEELPKVREAAENELRKQQRNVEDISLQKIRAESEAKQYRRELETIVREKEAAERELERVRQLTIEAEAKRAAVEENLLNFRNQLEENTFTRRTLEDHLKRKDLSLNDLEQQKNKLMEELRRKRDNEEELLKLIKQMEKDLAFQKQVAEKQLKEKQKIELEARRKITEIQYTCRENALPVCPITQATSCRAVTGLQQEHDKQKAEELKQQVDELTAANRKAEQDMRELTYELNALQLEKTSSEEKARLLKDKLDETNNTLRCLKLELERKDQAEKGYSQQLRELGRQLNQTTGKAEEAMQEASDLKKIKRNYQLELESLNHEKGKLQREVDRITRAHAVAEKNIQHLNSQIHSFRDEKELERLQICQRKSDHLKEQFEKSHEQLLQNIKAEKENNDKIQRLNEELEKSNECAEMLKQKVEELTRQNNETKLMMQRIQAESENIVLEKQTIQQRCEALKIQADGFKDQLRSTNEHLHKQTKTEQDFQRKIKCLEEDLAKSQNLVSEFKQKCDQQNIIIQNTKKEVRNLNAELNASKEEKRRGEQKVQLQQAQVQELNNRLKKVQDELHLKTIEEQMTHRKMVLFQEESGKFKQSAEEFRKKMEKLMESKVITENDISGIRLDFVSLQQENSRAQENAKLCETNIKELERQLQQYREQMQQGQHMEANHYQKCQKLEDELIAQKREVENLKQKMDQQIKEHEHQLVLLQCEIQKKSTAKDCTFKPDFEMTVKECQHSGELSSRNTGHLHPTPRSPLLRWTQEPQPLEEKWQHRVVEQIPKEVQFQPPGAPLEKEKSQQCYSEYFSQTSTELQITFDETNPITRLSEIEKIRDQALNNSRPPVRYQDNACEMELVKVLTPLEIAKNKQYDMHTEVTTLKQEKNPVPSAEEWMLEGCRASGGLKKGDFLKKGLEPETFQNFDGDHACSVRDDEFKFQGLRHTVTARQLVEAKLLDMRTIEQLRLGLKTVEEVQKTLNKFLTKATSIAGLYLESTKEKISFASAAERIIIDKMVALAFLEAQAATGFIIDPISGQTYSVEDAVLKGVVDPEFRIRLLEAEKAAVGYSYSSKTLSVFQAMENRMLDRQKGKHILEAQIASGGVIDPVRGIRVPPEIALQQGLLNNAILQFLHEPSSNTRVFPNPNNKQALYYSELLRMCVFDVESQCFLFPFGERNISNLNVKKTHRISVVDTKTGSELTVYEAFQRNLIEKSIYLELSGQQYQWKEAMFFESYGHSSHMLTDTKTGLHFNINEAIEQGTIDKALVKKYQEGLITLTELADSLLSRLVPKKDLHSPVAGYWLTASGERISVLKASRRNLVDRITALRCLEAQVSTGGIIDPLTGKKYRVAEALHRGLVDEGFAQQLRQCELVITGIGHPITNKMMSVVEAVNANIINKEMGIRCLEFQYLTGGLIEPQVHSRLSIEEALQVGIIDVLIATKLKDQKSYVRNIICPQTKRKLTYKEALEKADFDFHTGLKLLEVSEPLMTGISSLYYSS

SEQ ID NO: 820214 - protein, 2825 aa, Homo sapiens
MSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIKRCKETSEHGAYSDLLQRQKATVLENSKLTGKISELERMVAELKKQKSRVEEELPKVREAAENELRKQQRNVEDISLQKIRAESEAKQYRRELETIVREKEAAERELERVRQLTIEAEAKRAAVEENLLNFRNQLEENTFTRRTLEDHLKRKDLSLNDLEQQKNKLMEELRRKRDNEEELLKLIKQMEKDLAFQKQVAEKQLKEKQKIELEARRKITEIQYTCRENALPVCPITQATSCRAVTGLQQEHDKQKAEELKQQVDELTAANRKAEQDMRELTYELNALQLEKTSSEEKARLLKDKLDETNNTLRCLKLELERKDQAEKGYSQQLRELGRQLNQTTGKAEEAMQEASDLKKIKRNYQLELESLNHEKGKLQREVDRITRAHAVAEKNIQHLNSQIHSFRDEKELERLQICQRKSDHLKEQFEKSHEQLLQNIKAEKENNDKIQRLNEELEKSNECAEMLKQKVEELTRQNNETKLMMQRIQAESENIVLEKQTIQQRCEALKIQADGFKDQLRSTNEHLHKQTKTEQDFQRKIKCLEEDLAKSQNLVSEFKQKCDQQNIIIQNTKKEVRNLNAELNASKEEKRRGEQKVQLQQAQVQELNNRLKKVQDELHLKTIEEQMTHRKMVLFQEESGKFKQSAEEFRKKMEKLMESKVITENDISGIRLDFVSLQQENSRAQENAKLCETNIKELERQLQQYREQMQQGQHMEANHYQKCQKLEDELIAQKREVENLKQKMDQQIKEHEHQLVLLQCEIQKKSTAKDCTFKPDFEMTVKECQHSGELSSRNTGHLHPTPRSPLLRWTQEPQPLEEKWQHRVVEQIPKEVQFQPPGAPLEKEKSQQCYSEYFSQTSTELQITFDETNPITRLSEIEKIRDQALNNSRPPVRYQDNACEMELVKVLTPLEIAKNKQYDMHTEVTTLKQEKNPVPSAEEWMLEGCRASGGLKKGDFLKKGLEPETFQNFDGDHACSVRDDEFKFQGLRHTVTARQLVEAKLLDMRTIEQLRLGLKTVEEVQKTLNKFLTKATSIAGLYLESTKEKISFASAAERIIIDKMVALAFLEAQAATGFIIDPISGQTYSVEDAVLKGVVDPEFRIRLLEAEKAAVGYSYSSKTLSVFQAMENRMLDRQKGKHILEAQIASGGVIDPVRGIRVPPEIALQQGLLNNAILQFLHEPSSNTRVFPNPNNKQALYYSELLRMCVFDVESQCFLFPFGERNISNLNVKKTHRISVVDTKTGSELTVYEAFQRNLIEKSIYLELSGQQYQWKEAMFFESYGHSSHMLTDTKTGLHFNINEAIEQGTIDKALVKKYQEGLITLTELADSLLSRLVPKKDLHSPVAGYWLTASGERISVLKASRRNLVDRITALRCLEAQVSTGGIIDPLTGKKYRVAEALHRGLVDEGFAQQLRQCELVITGIGHPITNKMMSVVEAVNANIINKEMGIRCLEFQYLTGGLIEPQVHSRLSIEEALQVGIIDVLIATKLKDQKSYVRNIICPQTKRKLTYKEALEKADFDFHTGLKLLEVSEPLMTGISSLYYSS

SEQ ID NO: 820215 - protein, 2711 aa, Homo sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIKRCKETSEHGAYSDLLQRQKATVLENSKLTGKISELERMVAELKKQKSRVEEELPKVREAAENELRKQQRNVEDISLQKIRAESEAKQYRRELETIVREKEAAERELERVRQLTIEAEAKRAAVEENLLNFRNQLEENTFTRRTLEDHLKRKDLSLNDLEQQKNKLMEELRRKRDNEEELLKLIKQMEKDLAFQKQVAEKQLKEKQKIELEARRKITEIQYTCRENALPVCPITQATSCRAVTGLQQEHDKQKAEELKQQVDELTAANRKAEQDMRELTYELNALQLEKTSSEEKARLLKDKLDETNNTLRCLKLELERKDQAEKGYSQQLRELGRQLNQTTGKAEEAMQEASDLKKIKRNYQLELESLNHEKGKLQREVDRITRAHAVAEKNIQHLNSQIHSFRDEKELERLQICQRKSDHLKEQFEKSHEQLLQNIKAEKENNDKIQRLNEELEKSNECAEMLKQKVEELTRQNNETKLMMQRIQAESENIVLEKQTIQQRCEALKIQADGFKDQLRSTNEHLHKQTKTEQDFQRKIKCLEEDLAKSQNLVSEFKQKCDQQNIIIQNTKKEVRNLNAELNASKEEKRRGEQKVQLQQAQVQELNNRLKKVQDELHLKTIEEQMTHRKMVLFQEESGKFKQSAEEFRKKMEKLMESKVITENDISGIRLDFVSLQQENSRAQENAKLCETNIKELERQLQQYREQMQQGQHMEANHYQKCQKLEDELIAQKREVENLKQKMDQQIKEHEHQLVLLQCEIQKKSTAKDCTFKPDFEMTVKECQHSGELSSRNTGHLHPTPRSPLLRWTQEPQPLEEKWQHRVVEQIPKEVQFQPPGAPLEKEKSQQCYSEYFSQTSTELQITFDETNPITRLSEIEKIRDQALNNSRPPVRYQDNACEMELVKVLTPLEIAKNKQYDMHTEVTTLKQEKNPVPSAEEWMLEGCRASGGLKKGDFLKKGLEPETFQNFDGDHACSVRDDEFKFQGLRHTVTARQLVEAKLLDMRTIEQLRLGLKTVEEVQKTLNKFLTKATSIAGLYLESTKEKISFASAAERIIIDKMVALAFLEAQAATGFIIDPISGQTYSVEDAVLKGVVDPEFRIRLLEAEKAAVGYSYSSKTLSVFQAMENRMLDRQKGKHILEAQIASGGVIDPVRGIRVPPEIALQQGLLNNAILQFLHEPSSNTRVFPNPNNKQALYYSELLRMCVFDVESQCFLFPFGERNISNLNVKKTHRISVVDTKTGSELTVYEAFQRNLIEKSIYLELSGPFWDTGFSLFRSKK

SEQ ID NO: 820216 - protein, 1458 aa, Homo sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISK

SEQ ID NO: 820217 - protein, 331 aa, Homo sapiens
MGNVCGCVRAEKEEQYVDPAKTPLNPEKYSPGRKYFRRKPIKKTGGDKESVGANNENEGKKKSSSQPSKEQPAPLSRGLVQQESVTLNSALGDGIQQKKTEVVADSVKQKLLPSAVSSWSDCVNTSPAKDSETEVKVSELDERISEKDSTPYCAKRKKHLDDVNTSEITFQEKTDVFSFRKAASLSSIPSGIERSLEKSGFPEDPPKSYSSIQEKQNTERFCPHATQHFQFKKKRCHSLYTSMSSVSKDTDGNEISDIHVTGESEDMSAKERLLLWTQQATEGYAGIRCENFTTCWRDGKLFNAIIHKYRYGICVFFPYTTVRHISFISEF

SEQ ID NO: 820218 - protein, 521 aa, Homo sapiens
AQKFYPSSLSTMYRALRLLARSRPLVRAPAAALASAPGLGGAAVPSFWPPNAARMASQNSFRIEYDTFGELKVPNDKYYGAQTVRSTMNFKIGGVTERMPTPVIKAFGILKRAAAEVNQDYGLDPKIANAIMKAADEVAEGKLNDHFPLVVWQTGSGTQTNMNVNEVISNRAIEMLGGELGSKIPVHPNDHVNKSQSSNDTFPTAMHIAAAIEVHEVLLPGLQKLHDALDAKSKEFAQIIKIGRTHTQDAVPLTLGQEFSGYVQQVKYAMTRIKAAMPRIYELAAGGTAVGTGLNTRIGFAEKVAAKVAALTGLPFVTAPNKFEALAAHDALVELSGAMNTTACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTALNPHIGYDKAAKIAKTAHKNGSTLKETAIELGYLTAEQFDEWVKPKDMLGPK

SEQ ID NO: 820219 - protein, 133 aa, Homo sapiens
ASVSFTENCVVGIQANTERINKLMNESANVFKPMMIKNVLHSARLLGDASVSFTENCVVGIQANTERINKLMNESLMLVTALNPHIGYDKAAKIAKTAHKNGSTLKETAIELGYLTAEQFDEWVKPKDMLGPK

SEQ ID NO: 820220 - protein, 521 aa, Homo sapiens; identical to SEQ ID NO: 820218

SEQ ID NO: 820221 - protein, 501 aa, Homo sapiens
AQKFYPSSLSTMYRALRLLARSRPLVRAPAAALASAPGLGGAAVPSFWPPNAARMASQNSFRIEYDTFGELKVPNDKYYGAQTVRSTMNFKIGGVTERMPTPVIKAFGILKRAAAEVNQDYGLDPKIANAIMKAADEVAEGKLNDHFPLVVWQTGSGTQTNMNVNEVISNRAIEMLGGELGSKIPVHPNDHVNKSQSSNDTFPTAMHIAAAIEVHEVLLPGLQKLHDALDAKSKEFAQIIKIGRTHTQDAVPLTLGQEFSGYVQQVKYAMTRIKAAMPRIYELAAGGTAVGTGLNTRIGFAEKVAAKVAALTGLPFVTAPNKFEALAAHDALVELSGAMNTTACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTVTISIGYEQAQRCKTHKMVTKGRSNGTKRTCHG

SEQ ID NO: 820222 - protein, 434 aa, Homo sapiens
MNFKIGGVTERMPTPVIKAFGILKRAAAEVNQDYGLDPKIANAIMKAADEVAEGKLNDHFPLVVWQTGSGTQTNMNVNEVISNRAIEMLGGELGSKIPVHPNDHVNKSQSSNDTFPTAMHIAAAIEVHEVLLPGLQKLHDALDAKSKEFAQIIKIGRTHTQDAVPLTLGQEFSGYVQQVKYAMTRIKAAMPRIYELAAGGTAVGTGLNTRIGFAEKVAAKVAALTGLPFVTAPNKFEALAAHDALVELSGAMNTTACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTALNPHIGYDKAAKIAKTAHKNGSTLKETAIELGYLTAEQFDEWVKPKDMLGPK

SEQ ID NO: 820223 - protein, 442 aa, Homo sapiens
GPLSCYFTGPWSTINMNNSMTTPVIKAFGILKRAAAEVNQDYGLDPKIANAIMKAADEVAEGKLNDHFPLVVWQTGSGTQTNMNVNEVISNRAIEMLGGELGSKIPVHPNDHVNKSQSSNDTFPTAMHIAAAIEVHEVLLPGLQKLHDALDAKSKEFAQIIKIGRTHTQDAVPLTLGQEFSGYVQQVKYAMTRIKAAMPRIYELAAGGTAVGTGLNTRIGFAEKVAAKVAALTGLPFVTAPNKFEALAAHDALVELSGAMNTTACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTALNPHIGYDKAAKIAKTAHKNGSTLKETAIELGYLTAEQFDEWVKPKDMLGPK

SEQ ID NO: 820224 - protein, 423 aa, Homo sapiens [sequence omitted]

SEQ ID NO: 820225 - protein, 316 aa, Homo sapiens [sequence omitted]

SEQ ID NO: 820226 - protein, 199 aa, Homo sapiens
AQKFYPSSLSTMYRALRLLARSRPLVRAPAAALASAPGLGGAAVPSFWPPNAARMASQNSFRIEYDTFGELKVPNDKYYGAQTVRSTMNFKIGGVTERMPTPVIKAFGILKRAAAEVNQDYGLDPKIANAIMKAADEVAEGKLNDHFPLVVWQTGSGTQTNMNVNEVISNRAIEMLGGELGSKIPVHPNDHVNKSQVSM

SEQ ID NO: 820227 - protein, 521 aa, Homo sapiens; identical to SEQ ID NO: 820218

SEQ ID NO: 820228 - protein, 521 aa, Homo sapiens; identical to SEQ ID NO: 820218

SEQ ID NO: 820229 - protein, 528 aa, Homo sapiens
SLNGSAAPPLGARARKLYTTGRVRLLARSRPLVRAPAAALASAPGLGGAAVPSFWPPNAARMASQNSFRIEYDTFGELKVPNDKYYGAQTVRSTMNFKIGGVTERMPTPVIKAFGILKRAAAEVNQDYGLDPKIANAIMKAADEVAEGKLNDHFPLVVWQTGSGTQTNMNVNEVISNRAIEMLGGELGSKIPVHPNDHVNKSQSSNDTFPTAMHIAAAIEVHEVLLPGLQKLHDALDAKSKEFAQIIKIGRTHTQDAVPLTLGQEFSGYVQQVKYAMTRIKAAMPRIYELAAGGTAVGTGLNTRIGFAEKVAAKVAALTGLPFVTAPNKFEALAAHDALVELSGAMNTTACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTALNPHIGYDKAAKIAKTAHKNGSTLKETAIELGYLTAEQFDEWVKPKDMLGPK

SEQ ID NO: 820230 - protein, 434 aa, Homo sapiens; identical to SEQ ID NO: 820222

SEQ ID NO: 820231 - protein, 503 aa, Homo sapiens
AQKFYPSSLSTMYRALRLLARSRPLVRAPAAALASAPGLGGAAVPSFWPPNAARMASQNSFRIEYDTFGELKVPNDKYYGAQTVRSTMNFKIGGVTERMPTPVIKAFGILKRAAAEVNQDYGLDPKIANAIMKAADEVAEGKLNDHFPLVVWQTGSGTQTNMNVNEVISNRAIEMLGGELGSKIPVHPNDHVNKSQSSNDTFPTAMHIAAAIEVHEVLLPGLQKLHDALDDAVPLTLGQEFSGYVQQVKYAMTRIKAAMPRIYELAAGGTAVGTGLNTRIGFAEKVAAKVAALTGLPFVTAPNKFEALAAHDALVELSGAMNTTACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTALNPHIGYDKAAKIAKTAHKNGSTLKETAIELGYLTAEQFDEWVKPKDMLGPK

SEQ ID NO: 820232 - protein, 329 aa, Homo sapiens
MLGTGRTDKTLSDWHIAAAIEVHEVLLPGLQKLHDALDAKSKEFAQIIKIGRTHTQDAVPLTLGQEFSGYVQQVKYAMTRIKAAMPRIYELAAGGTAVGTGLNTRIGFAEKVAAKVAALTGLPFVTAPNKFEALAAHDALVELSGAMNTTACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTALNPHIGYDKAAKIAKTAHKNGSTLKETAIELGYLTAEQFDEWVKPKDMLGPK

SEQ ID NO: 820233 - protein, 636 aa, Homo sapiens
RARAPAAPMGVQGFQDYIEKHCPSAVVPVELQKLARGSLVGGGRQRPPQTPLRLLVDADNCLHRLYGGFYTDWVSGGQWNHMLGYLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKVLSKGPWSGFCYLMSGHSYGCFVLLSFFEPFFCLTNLLETKFTFPFLNIE

SEQ ID NO: 820234 - protein, 121 aa, Homo sapiens
FWSSVAVVRVVALVFVGFSSGMAVVCARFHVGVVCRLSWPSGLVGWLSWCVSFVGYASSFLPAILPFSNLACSFPATGSSWKQAGYRVIEGVSPEPLGAANISAAAAALANVVSPVTARRV

SEQ ID NO: 820235 - protein, 1126 aa, Homo sapiens
RARAPAAPMGVQGFQDYIEKHCPSAVVPVELQKLARGSLVGGGRQRPPQTPLRLLVDADNCLHRLYGGFYTDWVSGGQWNHMLGYLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKGEIKIAVSIEDEANKDLPPAALLYRPVRQYVYGVLFSLAESRKKTERLAFRKNRLPPEFSPVIIKEWAAYKGKSPQTPELVEALAFREWTCPNLKRLWLGKAVEDKNRRMRAFLACMRSDTPAMLNPANVPTHLMVLCCVLRYMVQWPGARILRRQELDAFLAQALSPKLYEPDQLQELKIENLDPRGIQLSALFMSGVDMALFANDACGQPIPWEHCCPWMYFDGKLFQSKLLKASREKTPLIDLCDGQADQAAKVEKMRQSVLEGLSFSRQSHTLPFPPPPALPFYPASAYPRHFGPVPPSQGRGRGFAGVCGFGGPYGETVATGPYRAFRVAAASGHCGAFSGSDSSRTSKSQGGVQPIPSQGGKLEIAGTVVGHWAGSRRGRGGRGPFPLQVVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 820236 - protein, 1140 aa, Homo sapiens
MVNRAFSLTRWVSGWFLVLSMPLQNLTLVFQIGLKNDLSVGGFVVFFETLLLTEQLLEIFFTGSMGASLAKPCACRLHVLGSSCPATACRLHPAPLQRFLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKGEIKIAVSIEDEANKDLPPAALLYRPVRQYVYGVLFSLAESRKKTERLAFRKNRLPPEFSPVIIKEWAAYKGKSPQTPELVEALAFREWTCPNLKRLWLGKAVEDKNRRMRAFLACMRSDTPAMLNPANVPTHLMVLCCVLRYMVQWPGARILRRQELDAFLAQALSPKLYEPDQLQELKIENLDPRGIQLSALFMSGVDMALFANDACGQPIPWEHCCPWMYFDGKLFQSKLLKASREKTPLIDLCDGQADQAAKVEKMRQSVLEGLSFSRQSHTLPFPPPPALPFYPASAYPRHFGPVPPSQGRGRGFAGVCGFGGPYGETVATGPYRAFRVAAASGHCGAFSGSDSSRTSKSQGGVQPIPSQGGKLEIAGTVVGHWAGSRRGRGGRGPFPLQVVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE
